US007932032B2

(12) United States Patent
Akiyama et al.

(10) Patent No.: US 7,932,032 B2
(45) Date of Patent: Apr. 26, 2011

(54) METHOD FOR DIAGNOSING ESOPHAGEAL CANCER

(75) Inventors: Hideo Akiyama, Kanagawa (JP); Satoko Kozono, Kanagawa (JP); Akira Myomoto, Shiga (JP); Osamu Nomura, Kanagawa (JP); Hitoshi Nobumasa, Shiga (JP); Yoshinori Tanaka, Kanagawa (JP); Shiori Tomoda, Tokyo (JP); Yutaka Shimada, Kyoto (JP); Gozoh Tsujimoto, Kyoto (JP)

(73) Assignees: Toray Industries, Inc., Tokyo (JP); Kyoto University, Kyoto-shi (JP)

( * ) Notice: Subject to any disclaimer, the term of this patent is extended or adjusted under 35 U.S.C. 154(b) by 477 days.

(21) Appl. No.: 11/919,679

(22) PCT Filed: May 2, 2006

(86) PCT No.: PCT/JP2006/309177

§ 371 (c)(1), (2), (4) Date: Jan. 8, 2008

(87) PCT Pub. No.: WO2006/118308

PCT Pub. Date: Nov. 9, 2006

(65) Prior Publication Data

US 2009/0270267 A1 Oct. 29, 2009

(30) Foreign Application Priority Data

May 2, 2005 (JP) ................................ 2005-134530
Sep. 13, 2005 (JP) ................................ 2005-265645
Sep. 13, 2005 (JP) ................................ 2005-265678

(51) Int. Cl.
*C12Q 1/68* (2006.01)
*C12P 19/34* (2006.01)
*C07H 21/02* (2006.01)
*C07H 21/04* (2006.01)

(52) U.S. Cl. ....... 435/6; 435/7.21; 435/91.2; 435/91.21; 435/91.51; 536/23.5

(58) Field of Classification Search ........................ None
See application file for complete search history.

(56) References Cited

U.S. PATENT DOCUMENTS 5,990,299 A * 11/1999 Ruzdijic et al. .............. 536/24.5
2003/0073105 A1 4/2003 Lasek et al.
2009/0270267 A1 * 10/2009 Akiyama et al. .................. 506/9

FOREIGN PATENT DOCUMENTS

WO WO-01/74405 A1 10/2001
WO WO-01/94629 A2 12/2001
WO WO-2004/048938 A2 6/2004
WO WO-2005/031001 A2 4/2005

OTHER PUBLICATIONS

Tomatsu et al. Journal Inherited Metabolism Disease. 1994. 17: 601-605.*
National Center For Biotechnology Information, National Library of Medicine, NIH (Bethesda, MD, USA) GenBank Accession No. NM_000512, Mar. 23, 2005.*
Coleman. Drug Discovery Today. 2003. 8: 233-235.*
Liu et al. Clinical Immunology. 2004. 112: 225-230.*
Saetre et al. Molecular Brain Research. 2004. 126: 198-206.*
GeneCard for GALNS, available via url: <genecards.org/cgi-bin/carddisp.pl?gene=GALNS>, printed Jun. 29, 2010.*
Dahlberg et al. Ann Thorac Surg. 2004. 77: 1008-1015.*
Kimos et al., "Esophagin and proliferating cell nuclear antigen (PCNA) are biomarkers of human esophageal neoplastic progression," Int. J. Cancer, 2004, vol. 111, No. 3, pp. 415-417.
Nemoto T et al.; "Overexpression of Protein Tyrosine Kinases in Human Esophageal Cancer", Pathobiology, 1997, vol. 65, pp. 195-203, XP009048170.
Ginkel et al., "Expression of the receptor tyrosine kinase Axl promotes ocular melanoma cell survival," Cancer Res., 2004, vol. 64, No. 1, pp. 128-134.
Su et al., "Gene expression analysis of esophageal squamous cell carcinoma reveals consistent molecular profiles related to a family history of upper gastrointestinal cancer," Cancer Res., 2003, vol. 63, No. 14, pp. 3872-3876.
Ebihara et al., "DARPP-32 expression arises after a phase of dysplasia in oesophageal squamous cell carcinoma," Br.J. Cancer, 2004, vol. 91, No. 1, pp. 119-123.

* cited by examiner

*Primary Examiner* — Carla Myers
(74) *Attorney, Agent, or Firm* — Birch, Stewart, Kolasch and Birch, LLP

(57) ABSTRACT

This invention relates to a composition, kit, or DNA chip comprising polynucleotides and antibodies as probes for detecting, determining, or predicting the presence or metastasis of esophageal cancer, and to a method for detecting, determining, or predicting the presence or metastasis of esophageal cancer using the same.

8 Claims, 5 Drawing Sheets

METHOD FOR DIAGNOSING ESOPHAGEAL CANCER

FIELD OF THE INVENTION

The present invention relates to a composition for diagnosing (i.e., detecting, determining, or predicting) esophageal cancer and metastasis of esophageal cancer, to a method for detecting, determining, or predicting the presence or metastasis of esophageal cancer using the composition, and to a kit for diagnosing the esophageal cancer or the metastasis of the esophageal cancer using the composition.

BACKGROUND OF THE INVENTION

The esophagus is a luminal organ that connects the pharynges and the stomach. The major parts thereof are present in the thoracic cavity, and some parts are present in the cervical region and in the abdominal cavity. In the upper portion of the thoracic cavity, the esophagus is located between the trachea and the spine, and it is surrounded by the heart, the aorta, and the lungs in the lower portion. The esophagus delivers food ingested via the mouth to the stomach.

In 2001, the cancer mortality was 238.8 out of 100,000 patients in Japan. The percentages of total deaths accounted for by esophageal cancer have been increasing every year. In fiscal 2001, 5.0% of the male patients who died of cancer died of esophageal cancer, and 1.4% of such female patients died of esophageal cancer. The peak ages for the onset of esophageal cancer are in the 60s to 70s, and males are more likely to develop esophageal cancer. Also, environmental factors such as smoking, drinking, or preference for hot foods are closely related to the development of esophageal cancer. Further, it is known that blood vessels and lymph ducts are abundant in or around the esophageal wall and thus a cancer developed in the esophagus often metastasizes.

Methods for treating esophageal cancer are determined in accordance with the degree of progress (the Japan Esophageal Society (ed.), Clinical Pathology: Rules for Treating Esophageal Cancer, 1999), metastasis, and general medical conditions. The standard method for treating esophageal cancer is described in "Guidelines for Treating Esophageal Cancer" (the Japan Esophageal Society, 2002). At present, the most common treatment method is surgery. The esophagus, including the cancerous portion, and surrounding tissues, including lymph glands, are excised (i.e., lymph node dissection), and thereafter the esophagus is reconstructed using other organs, such as stomach. Surgery, particularly extensive regional lymph node dissection, imposes serious burdens upon patients, and thus, lowered QOL after surgery should be an issue of concern. The early-stage cancer that remains in the mucosa may be occasionally treated by endoscopic demucosation. Also, radiation therapy may be occasionally carried out for both radical cures and symptomatic therapy. Further, chemotherapy may be carried out in combination with surgery or radiation therapy. At present, use of 5-fluorouracil in combination with cisplatin is considered to be the most effective chemotherapy.

Esophageal cancer is often found by consultation with a patient who has noticed symptoms, such as discomfort while swallowing, swallowing difficulty, retrosternal pain, or chest discomfort. These symptoms, however, occur as a result of the growth of cancer in the esophagus, and the cancer, which is found at the time of consultation following self-detection, has already progressed or metastasized outside the esophageal wall, and such a cancer often indicates a poor prognosis. Accordingly, lymph nodes around the esophagus are often dissected at surgery. If the presence or absence of metastasis can previously be expected, the area of the dissection can be accurately determined prior to surgery, or the area of the dissection can be limited thereby contributing to the patient's QOL after surgery.

Esophageal cancer is definitely diagnosed by the imaging test, endoscopy, and biopsy in the esophagus. Biopsy specimens are collected at the time of endoscopy or surgery, pathological specimens are prepared, and the diagnosis is made on the basis of the histopathological classification. Accordingly, there is a demand on development of a simple, rapid diagnosis technique that can predict the presence or absence of metastasis outside the esophagus based on the properties of cells obtained by endoscopy.

Until now, the molecular-biological diagnosis technique that involves the use of markers contained specifically in esophageal cancer tissues has been proposed, which technique can rapidly produce objective results and assist rapid diagnosis.

As the markers for clinical diagnosis of esophageal cancer, serum protein markers, such as SCC, CYFRA21-1 and CEA, have been used so far. Besides them, proteins as described in JP Patent Publication (kokai) No. 2003-259872 A and JP Patent Publication (kohyo) No. 2000-511536 A have also been reported. However, these markers have poor sensitivity and specificity, and the sensitivity of CYFRA21-1, which is likely to have the highest sensitivity, is as low as about 33.9% (Nakamura, T. et al., 1998, Diseases of the Esophagus, vol. 11, pp. 35-39) to about 43.9% (Kawaguchi, H. et. al., 2000, Cancer, vol. 89, pp. 1413-1417). Thus, this technique has not yet enabled to determine the presence or absence of esophageal cancer cells by detecting said serum markers alone or in combination, nor is it possible to diagnose the metastasis of esophageal cancer using said markers.

As another marker that utilizes genes for specifically determining whether or not a biopsy sample from a subject contains esophageal cancer cells, use of chromosome aberration (see, for example, JP Patent Publication (kokai) No. 2001-17200 A and JP Patent Publication (kokai) No. 2002-272497 A) and epigenetic sequences of genes (e.g., JP Patent Publication (kohyo) No. 2004-505612 A) has been disclosed. Also, a plurality of results of the exhaustive analysis of gene expression using a DNA chip have been reported (see, for example, Luo, A. et al., 2004, Oncogene, vol. 23, pp. 1291-1299; Zhi, H. et al., 2003, International Journal of Cancer, vol. 106, pp. 327-333; Lu, J. et al., 2001, International Journal of Cancer, vol. 91, pp. 288-294; Kazemi-Noureini, S. et al., 2004, World Journal of Gastroenterology, vol. 10, pp. 1716-1721; Xu, S. H. et al., 2003, World Journal of Gastroenterology, vol. 9, pp. 417-422; and Su, H. et al., 2003, Cancer Research, vol. 63, pp. 3872-3876). Furthermore, examples of the reported markers that utilize a single gene expression as an indicator, include: SPRR3 gene (Small proline-rich protein 3) as described in WO 2003/042661, Chen, B. S. et al., 2000, Carcinogenesis, vol. 21, pp. 2147-2150, Abraham, J. M. et al., 1996, Cell Growth & Differentiation, vol. 7, pp. 855-860; fgf3 gene as described in Kitagawa, Y. et al., 1991, Cancer Research, vol. 51, pp. 1504-1508; CSTB gene (cystatin B, liver thiol proteinase inhibitor) as described in WO 2003/042661 and Shiraishi, T. et al., 1998, International Journal of Cancer, vol. 79, pp. 175-178; UCP2 gene (mitochondrial uncoupling protein 2) as described in WO 2003/076594; UPK1A gene (uroplakin 1A) as described in WO 2003/042661; and HSPA1B gene (heat shock 70 kDa protein 1) as described in Kawanishi, K. et al., 1999, Cancer, vol. 85, pp. 1649-1657.

DISCLOSURE OF THE INVENTION

Problems to be Solved by the Invention

The aforementioned known indicators, however, are disadvantageously poor in specificity and/or sensitivity. Also, a method for effectively detecting such indicators from biological samples has not yet been established. For these reasons, said indicators are not generally used in the clinical field. Additionally, at present, it is considered impossible to detect the presence or absence of the metastasis of esophageal cancer, which is a key factor in determining a patient's prognosis, using diagnostic markers. Accordingly, development of markers for the metastasis of esophageal cancer with high specificity and sensitivity has been desired strongly.

An object of the invention is to provide a composition, kit, or DNA chip, which is useful for diagnosing esophageal cancer, for diagnosing the metastasis of esophageal cancer, and for treating esophageal cancer.

Another object of the invention is to provide a method for detecting, determining, or predicting the presence or metastasis of esophageal cancer using the composition, kit, or DNA chip.

Means for Solving Problems

Examples of methods for searching for markers include: a method wherein gene expression levels, protein expression levels, or amounts of cellular metabolites in esophageal cancer cells and in non-cancerous cells are compared by a certain means; a method wherein the amounts of genes, proteins, or metabolites contained in the body fluids of an esophageal cancer patient and of a non-cancerous patient are measured; a method wherein gene expression levels, protein expression levels, or amounts of cellular metabolite in esophageal cancer cells from a patient who exhibited metastasis to the lymph nodes at the time of surgery and in esophageal cancer cells from a patient who did not exhibit metastasis to the lymph nodes at the time of surgery are compared by a certain means; and a method wherein the amounts of genes, proteins, or metabolites contained in the body fluids of a patient with metastatic esophageal cancer and of a patient with non-metastatic esophageal cancer are measured.

In recent years, DNA-array-based analysis of gene expression levels has been commonly used as a method for searching for markers. On a DNA array, probes that utilize nucleotide sequences corresponding to several hundreds to several tens of thousands of gene species are immobilized. When samples to be tested are applied to such a DNA array, genes contained in the samples bind to probes, and the amount of the binding may be measured by a certain means to determine the amounts of genes in the samples. Genes corresponding to the probes immobilized on DNA array can be freely selected. Also, esophageal cancer cells obtained from a patient exhibiting metastasis to the lymph nodes at surgery and esophageal cancer cells obtained from a patient not exhibiting metastasis to the lymph nodes at surgery may be used as a sample for comparison of gene expression levels. Thus, genes that can function as markers for metastatic esophagus cancer can be predicted.

In order to solve the above problems, we analyzed the gene expression in an esophageal cancer tissue and in a non-cancerous tissue using a DNA array, whereby we have now found genes capable of using as markers for detection of esophageal cancer, and we have further found that the expression levels of the genes in the esophageal cancer tissue significantly varied from those in the non-cancerous tissue, and that there were present protein markers detected specifically in the blood plasma of esophageal cancer patients rather than in the blood plasma of healthy volunteers. Moreover, we analysed using a DNA array the gene expression in an esophageal cancer tissue from a patient exhibiting metastasis to the lymph nodes at surgery and in an esophageal cancer tissue from a patient not exhibiting metastasis to the lymph nodes at surgery, whereby we have now found genes capable of using as markers for detection of the metastasis of esophageal cancer, and we have further found that the expression levels of the genes significantly changed in the esophageal cancer cells from the patient exhibiting metastasis to the lymph nodes at surgery when compared with the esophageal cancer cells from the patient not exhibiting metastasis to the lymph nodes at surgery. These findings have led to the completion of the present invention.

1. SUMMARY OF THE INVENTION

The present invention includes the following characteristics.

(1) A composition for detecting, determining, or predicting the presence or metastasis of esophageal cancer in a subject in vitro comprising one or more probes selected from the probes of the following group I, group II, and/or group III:

group I: polynucleotides consisting of:

(a) a polynucleotide consisting of a nucleotide sequence as shown in any of SEQ ID NOS: 1 to 46, a mutant thereof, or a fragment thereof comprising at least 15 continuous nucleotides, (b) a polynucleotide comprising a nucleotide sequence as shown in any of SEQ ID NOS: 1 to 46, (c) a polynucleotide consisting of a nucleotide sequence complementary to a nucleotide sequence as shown in any of SEQ ID NOS: 1 to 46, a mutant thereof, or a fragment thereof comprising at least 15 continuous nucleotides, (d) a polynucleotide comprising a nucleotide sequence complementary to a nucleotide sequence as shown in any of SEQ ID NOS: 1 to 46, and (e) a polynucleotide hybridizing under stringent conditions to any of the polynucleotides (a) to (d), or a fragment thereof comprising at least 15 continuous nucleotides;

group II: polynucleotides consisting of:

(f) a polynucleotide consisting of a nucleotide sequence as shown in any of SEQ ID NOS: 142 to 155 and 157 to 161, a mutant thereof, or a fragment thereof comprising at least 15 continuous nucleotides, (g) a polynucleotide comprising a nucleotide sequence as shown in any of SEQ ID NOS: 142 to 155 and 157 to 161, (h) a polynucleotide consisting of a nucleotide sequence complementary to a nucleotide sequence as shown in any of SEQ ID NOS: 142 to 155 and 157 to 161, a mutant thereof, or a fragment thereof comprising at least 15 continuous nucleotides, (i) a polynucleotide comprising a nucleotide sequence complementary to a nucleotide sequence as shown in any of SEQ ID NOS: 142 to 155 and 157 to 161, and (j) a polynucleotide hybridizing under stringent conditions to any of the polynucleotides (f) to (i), or a fragment thereof comprising at least 15 continuous nucleotides; and group III: antibodies, fragments thereof or chemically modified derivatives thereof consisting of:

(k) an antibody specifically binding to at least one of polypeptides encoded by nucleotide sequences as shown in SEQ ID NOS: 1 to 46 or polypeptides having amino acid sequences as shown in SEQ ID NOS: 95 to 140, mutants thereof, and fragments thereof, or a fragment of the antibody, or a chemically modified derivative of the antibody or fragment, (l) an antibody specifically binding to at least one of polypeptides encoded by nucleotide sequences as shown in SEQ ID NOS: 142 to 155 and 157 to 161 or polypeptides having amino acid sequences as shown in SEQ ID NOS: 182 to 195 and 197 to 201, mutants thereof, and fragments thereof, or a fragment of the antibody, or a chemically modified derivative of the antibody or fragment, and (m) an antibody specifically binding to at least one of polypeptides having amino acid sequences as shown in SEQ ID NOS: 202 to 232, mutants thereof, and fragments thereof, or a fragment of the antibody, or a chemically modified derivative of the antibody or fragment thereof (2) The composition according to (1) above, wherein each of the probes of group I and group III (k) is capable of detecting, determining, or predicting the presence or metastasis of esophageal cancer.

(3) The composition according to (1) above, wherein each of the probes of group II and group III (l) and (m) is capable of detecting, determining, or predicting the presence of esophageal cancer.

(4) The composition according to (1) above, wherein the polynucleotides are DNA or RNA.

(5) The composition according to (1) above, wherein the fragments of group I and group II are each a polynucleotide comprising at least 60 continuous nucleotides.

(6) The composition according to (1) above, wherein the fragments of group I and group II are each a polynucleotide comprising a nucleotide sequence as shown in any of SEQ ID NOS: 48 to 93, 162 to 175, and 177 to 181 in the nucleotide sequence as shown in any of SEQ ID NOS: 1 to 46, 142 to 155, and 157 to 161, or a polynucleotide comprising a nucleotide sequence complementary thereto.

(7) The composition according to (1) above, wherein the fragments of group I and group II are each a polynucleotide comprising a nucleotide sequence as shown in any of SEQ ID NOS: 48 to 93, 162 to 175, and 177 to 181, or a nucleotide sequence complementary thereto.

(8) The composition according to (1) above, which further comprises, as a probe, a polynucleotide consisting of the nucleotide sequence as shown in SEQ ID NO: 47, a polynucleotide consisting of a complementary sequence thereof, a polynucleotide hybridizing under stringent conditions to said polynucleotide, or a fragment thereof comprising at least 15 continuous nucleotides, in addition to the probe or probes of group I.

(9) The composition according to (8) above, wherein the fragment is a polynucleotide comprising at least 60 continuous nucleotides.

(10) The composition according to (8) above, wherein the fragment is a polynucleotide comprising the nucleotide sequence as shown in SEQ ID NO: 94 in the nucleotide sequence as shown in SEQ ID NO: 47, or a polynucleotide comprising a nucleotide sequence complementary thereto.

(11) The composition according to (8) above, wherein the fragment is a polynucleotide comprising the nucleotide sequence as shown in SEQ ID NO: 94, or a nucleotide sequence complementary thereto.

(12) The composition according to (1) above, which further comprises, as a probe, a polynucleotide consisting of the nucleotide sequence as shown in SEQ ID NO: 156, a polynucleotide consisting of a complementary sequence thereof, a polynucleotide hybridizing to said polynucleotide under stringent conditions, or a fragment thereof comprising at least 15 continuous nucleotides, in addition to the probe or probes of group II.

(13) The composition according to (12) above, wherein the fragment is a polynucleotide comprising at least 60 continuous nucleotides.

(14) The composition according to (12) above, wherein the fragment is a polynucleotide comprising the nucleotide sequence as shown in SEQ ID NO: 176 in the nucleotide sequence as shown in SEQ ID NO: 156, or a polynucleotide comprising a nucleotide sequence complementary thereto.

(15) The composition according to (12) above, wherein the fragment is a polynucleotide comprising the nucleotide sequence as shown in SEQ ID NO: 176 or a nucleotide sequence complementary thereto.

(16) The composition according to (1) above, which further comprises an antibody binding specifically to at least one of the polypeptide as shown in SEQ ID NO: 233, a mutant thereof, and a fragment thereof, or a fragment of the antibody, or a chemically modified derivative of the antibody or fragment, in addition to the probe or probes of group III (m).

(17) The composition according to (1) above, wherein the fragment of the polypeptide or mutant comprises an epitope consisting of at least 7 amino acids.

(18) The composition according to (1) above, wherein each of the antibodies is a polyclonal antibody, a monoclonal antibody, a synthetic antibody, a recombinant antibody, a polyspecific antibody, or a single-chain antibody.

(19) The composition according to (1) above, which comprises at least two probes selected from the group I and/or group II, or group III, alone or in combination.

(20) A kit for detecting, determining, or predicting the presence or metastasis of esophageal cancer in a subject in vitro, comprising one or more probes selected from the probes of group I, group II, and/or group III as defined in (1) above.

(21) The kit according to (20), which further comprises, as a probe, a polynucleotide consisting of the nucleotide sequence as shown in SEQ ID NO: 47, a polynucleotide consisting of a complementary sequence thereof, a polynucleotide hybridizing to said polynucleotide under stringent conditions, or a fragment thereof comprising at least 15 continuous nucleotides.

(22) The kit according to (20) above, which further comprises, as a probe, a polynucleotide consisting of the nucleotide sequence as shown in SEQ ID NO: 156, a polynucleotide consisting of a complementary sequence thereof, a polynucleotide hybridizing to said polynucleotide under stringent conditions, or a fragment thereof comprising at least 15 continuous nucleotides.

(23) The kit according to (20), wherein the polynucleotide is a polynucleotide consisting of a nucleotide sequence as shown in any of SEQ ID NOS: 1 to 46 and 47, a polynucleotide consisting of a complementary sequence thereof, a polynucleotide hybridizing to said polynucleotide under stringent conditions, or a fragment thereof comprising at least 15 continuous nucleotides.

(24) The kit according to (20) above, wherein the polynucleotide is a polynucleotide consisting of a nucleotide sequence as shown in any of SEQ ID NOS: 142 to 155, 156, and 157 to 161, a polynucleotide consisting of a complementary sequence thereof, a polynucleotide hybridizing to said polynucleotide under stringent conditions, or a fragment thereof comprising at least 15 continuous nucleotides.

(25) The kit according to (20) above, wherein the fragments of group I and group II are each a polynucleotide comprising at least 60 continuous nucleotides.

(26) The kit according to (20) above, wherein the fragment of group I is a polynucleotide comprising a nucleotide sequence as shown in any of SEQ ID NOS: 48 to 93 and 94 in a polynucleotide comprising at least 60 continuous nucleotides of a nucleotide sequence as shown in any of SEQ ID NOS: 1 to 46 and 47 or a polynucleotide comprising a nucleotide sequence complementary thereto.

(27) The kit according to (20) above, wherein the fragment of group II is a polynucleotide comprising a nucleotide sequence as shown in any of SEQ ID NOS: 162 to 175, 176, and 177 to 181 in a polynucleotide comprising at least 60 continuous nucleotides of a nucleotide sequence as shown in any of SEQ ID NOS: 142 to 155, 156, and 157 to 161 or a polynucleotide comprising a nucleotide sequence complementary thereto.

(28) The kit according to (20) above, wherein the fragment of group I or group II is a polynucleotide comprising a nucleotide sequence as shown in any of SEQ ID NOS: 48 to 93, 94, 162 to 175, 176, and 177 to 181 or a nucleotide sequence complementary thereto.

(29) The kit according to (20) above, wherein the fragment of group I or group II is a polynucleotide consisting of a nucleotide sequence as shown in any of SEQ ID NOS: 48 to 93, 94, 162 to 175, 176, and 177 to 181.

(30) The kit according to (20) above, which comprises at least two or all of the polynucleotides comprising nucleotide sequences as shown in SEQ ID NOS: 48 to 93 and 94 or complementary sequences thereof

(31) The kit according to (20) above, which comprises at least two or all polynucleotides each comprising a nucleotide sequence as shown in any of SEQ ID NOS: 162 to 175, 176, and 177 to 181 or a complementary sequence thereof

(32) The kit according to (20) above, wherein the probes are packaged in different containers alone or in combination.

(33) A DNA chip for detecting, determining, or predicting the presence or metastasis of esophageal cancer in a subject in vitro, comprising one or more probes selected from the probes of group I and/or group II as defined in claim 1.

(34) The DNA chip according to (33) above, which further comprises a polynucleotide consisting of the nucleotide sequence as shown in SEQ ID NO: 47, a mutant thereof, and/or a fragment thereof

(35) The DNA chip according to (33) above, which further comprises a polynucleotide consisting of the nucleotide sequence as shown in SEQ ID NO: 156, a mutant thereof, and/or a fragment thereof

(36) The DNA chip according to (33) above, which comprises at least two or all of the polynucleotides comprising nucleotide sequences as shown in SEQ ID NOS: 48 to 93 and 94 or complementary sequences thereof

(37) The DNA chip according to (33) above, which comprises at least two or all of the polynucleotides comprising nucleotide sequences as shown in SEQ ID NOS: 162 to 175, 176, and 177 to 181 or complementary sequences thereof

(38) A method for detecting, determining, or predicting the presence or metastasis of esophageal cancer in vitro, comprising using a probe or probes selected from the probes of group I, group II, and/or group III as defined in (1) above, to measure in vitro the presence, amount, or expression level of one or more esophageal cancer-associated target nucleic acids in a biological sample from a subject.

(39) The method according to (38) above, wherein the measurement is carried out using a DNA chip.

(40) The method according to (38) above, wherein the presence or metastasis of esophageal cancer is detected, determined, or predicted using changes from a control sample as an indicator.

(41) The method according to (38) above, wherein the measurement is carried out by an immunological method.

(42) The method according to (41) above, wherein the measurement by the immunological method is carried out using the antibody or antibodies of group III, a fragment or fragments thereof, or a chemically modified derivative or derivatives thereof.

(43) The method according to (42) above, wherein the antibodies, fragments, or chemically modified derivatives are labeled.

(44) The method according to (38) above, wherein the biological sample is an esophageal tissue or cell, blood, blood plasma, blood serum, or urine.

(45) A method for detecting, determining, or predicting the presence or metastasis of esophageal cancer in vitro, comprising measuring in vitro the presence, amount, or expression level of one or more esophageal cancer-associated target nucleic acids in a biological sample from a subject using the composition according to (1)-(19) above, the kit according to (20)-(32) above, or the DNA chip according to (33)-(37) above.

(46) A method for detecting, determining, or predicting metastasis of esophageal cancer using a probe or probes selected from the group I as defined in (1)-(19) above, or the composition of (1) above, the kit of (20)-(32) above, or the DNA chip of (33)-(37) above, comprising the probe or probes, wherein the method comprises the steps of (1) measuring in vitro expression levels of esophageal cancer-associated target nucleic acids in a plurality of biological samples that are known to be of a tissue comprising metastatic cancer cells or non-metastatic cancer cells of esophageal cancer;

(2) preparing a discriminant, support vector machine, made using as training samples the expression levels of the target nucleic acids determined in step (1);

(3) measuring in vitro expression levels of the target nucleic acids in a biological sample obtained from the esophagus of the subject in the same manner as in step (1); and (4) assigning the expression levels of the target nucleic acids determined in step (3) to the discriminant prepared in step (2), and determining that the biological sample does not include metastatic cancer cells and/or that the biological sample includes non-metastatic cancer cells, based on the results obtained from the discriminant.

(47) A method for detecting esophageal cancer using a probe or probes selected from the probes of group II as defined in (1) above, or the composition of (1)-(19) above, the kit of (20)-(32) above, or the DNA chip of (33)-(37) above, comprising the probe or probes, wherein the method comprises the steps of:

(1) measuring in vitro expression levels of target nucleic acids in a plurality of biological samples that are known to be of an esophageal cancer cell-containing tissue or a normal tissue;

(2) preparing a discriminant, support vector machines, made using as training samples the expression levels of the target nucleic acids determined in step (1);

(3) a measuring in vitro expression level of the target nucleic acids in a biological sample obtained from the esophagus of the subject in the same manner as in step (1); and (4) assigning the expression levels of the target nucleic acids determined in step (3) to the discriminant prepared in step (2), and determining whether or not the biological sample includes cancer cells, based on the results obtained from the discriminant.

(48) Use of a probe or probes selected from the probes of group I, group II, and/or group III as defined in (1) above, or the composition of (1)-(19) above, the kit of (20)-(32) above, or the DNA chip of (33)-(37) above, comprising the probe or probes, for detecting, determining, or predicting the presence or metastasis of esophageal cancer in vitro in a biological sample from a subject.

2. DEFINITION

The terms as used herein have the definitions as set forth below.

The term "probe" as used herein refers to a nucleic acid, an antibody, or an equivalent thereof, which is for detecting, determining, or predicting the presence or metastasis of esophageal cancer, and which is capable of binding to a particular gene that is an esophageal cancer-associated marker, or to a polypeptide encoding the same.

Unless otherwise indicated herein, the meanings of terms such as nucleotide, polynucleotide, amino acid, peptide, polypeptide, and protein, and their abbreviations are in accordance with common usage in the art.

The term "polynucleotide" as used herein refers to a nucleic acid including each of RNA and DNA. Such DNA includes cDNA, genomic DNA, and synthetic DNA. Such RNA includes total RNA, mRNA, rRNA, and synthetic RNA. The term "polynucleotide" is used interchangeably with the term "nucleic acid."

The term "cDNA" as used herein refers to a full-length DNA strand of a sequence complementary to RNA resulting from gene expression, or a DNA fragment consisting of a partial sequence thereof cDNA can be synthesized via reverse transcriptase-polymerase chain reaction (RT-PCR) using RNA as a template and a poly T primer.

The term "gene" as used herein refers to not only double-stranded DNA but also single-stranded DNA such as a plus-strand (or a sense strand) or a complementary strand (or an antisense strand) constituting double-stranded DNA. It is not particularly limited by the length of such strand. Accordingly, the term "gene" refers to any of double-stranded DNA (including human genomic DNA), single-stranded DNA (plus-strand) (including cDNA), single-stranded DNA having a sequence complementary to the plus-strand (complementary strand), and a fragment thereof, unless otherwise specified. Such "gene" includes not only a "gene" represented by a specific nucleotide sequence (or a SEQ ID NO.) but also another "gene" encoding a protein, which has a biological function equivalent to that of a protein encoded by said gene, such as a homolog, a mutant such as a splice mutant, and a derivative. Specific examples of the "genes" encoding such homolog, mutant, or derivative include "genes" each having a nucleotide sequence which hybridizes to a sequence complementary to a specific nucleotide sequence as shown in any of SEQ ID NOS: 1 to 47 and 142 to 161 under stringent conditions as described below.

Examples of human-derived protein homologs or genes encoding the same include proteins or genes derived from other organism species corresponding to the human proteins or human genes encoding the same. Such protein homologs or gene homologs can be identified by HomoloGene (available on the internet). Specifically, a certain human amino acid or nucleotide sequence can be subjected to the BLAST programs (Karlin, S. et al., Proceedings of the National Academic Sciences, U.S.A., 1993, vol. 90, pp. 5873-5877) to obtain the accession number of the corresponding sequence (i.e., the sequence exhibiting the highest score, E-value 0, and identity 100%). Examples of the known BLAST programs include BLASTN (gene) and BLASTX (protein). When searching for a gene, for example, the accession number obtained from the above-mentioned BLAST search is inputted into the UniGene (available on the internet), and the obtained UniGeneClusterID (the number identified with "Hs.") is then inputted into the HomoloGene. From the list that shows the correlation of gene homologs between the genes of other organism species and the human genes, a gene of the other organism species can be selected as a gene homolog corresponding to the human gene represented by a given nucleotide sequence. In this procedure, the PASTA program (available on the internet) may be used instead of the BLAST program.

Functional regions of "genes" are not limited, and examples thereof include expression-control regions, coding regions, and exon or intron regions.

The term "transcription product" as used herein refers to messenger RNA (mRNA) which is synthesized from the DNA sequence of a gene as a template. Messenger RNA is synthesized by binding of RNA polymerase to a site called promoter, which is located upstream of the gene of interest, and subsequently by binding of ribonucleotides to the 3' end so as to be complementary to the nucleotide sequence of DNA. Such messenger RNA contains not only the gene of interest but also a full-length sequence spanning from a transcription initiation site to the terminus of a poly A sequence including expression control region, coding region, and exon or intron region.

The term "translation product" as used herein refers to a protein which is synthesized based on the information of messenger RNA synthesized via transcription regardless of modification such as splicing. During the translation process of messenger RNA, ribosome first binds to messenger RNA, amino acids are then linked in accordance with the nucleotide sequence of messenger RNA, thereby leading to the synthesis of a protein.

The term "primer" as used herein refers to a continuous polynucleotide that specifically recognizes and amplifies RNA resulting from gene expression or a polynucleotide derived therefrom, and/or a polynucleotide complementary thereto.

The complementary polynucleotide (i.e., a complementary strand or reverse strand) refers to a polynucleotide that is basically complementary to the full-length sequence of a polynucleotide having a nucleotide sequence as shown in a given SEQ ID NO. or a partial sequence thereof (herein, conveniently referred to as a "plus strand"), on the basis of the base pairing like A:T(U) or G:C. Such a complementary strand, however, is not limited to a sequence completely complementary to the nucleotide sequence of a plus strand of interest; that is, the complementary strand may have such a complementarity that it can hybridize to the plus strand under stringent conditions.

As used herein, the "stringent conditions" means such conditions that a probe can hybridize to a target sequence with a higher degree of detection when compared with its hybridization to other sequences (e.g., at least twice the background). Stringent conditions are dependent on the sequence of a target, varying depending on the environment where hybridization takes place. By controlling stringency of hybridization and/or washing conditions, a target sequence that is 100% complementary to the probe can be identified.

As used herein, the term "mutant" in case of a nucleic acid refers to a naturally-occurring mutant resulting from polymorphism, mutation, selective splicing during transcription, or the like, a mutant based on degeneracy of genetic cord, a mutant comprising a deletion, substitution, addition, or insertion of one or more nucleotides, preferably one or several nucleotides, in a nucleotide sequence thereof, a mutant having at least about 80%, at least about 85%, at least about 90%, at least about 95%, at least about 97%, at least about 98%, or at least about 99% identity with said nucleotide sequence or said partial sequence thereof, or a nucleic acid mutant that hybridizes to a polynucleotide or oligonucleotide comprising said nucleotide sequence or said partial sequence thereof under the stringent conditions as defined above. On the other hand, a "mutant" in case of a protein or peptide refers to a mutant comprising a deletion, substitution, addition, or insertion of one or more amino acids, preferably one or several amino acids, in an amino acid sequence as shown in any of SEQ ID NOS: 95 to 141, 182 to 201, and 202 to 233 or a partial sequence thereof, or a mutant having a % identity of at least about 80%, at least about 85%, at least about 90%, at least about 95%, at least about 97%, at least about 98%, or at least about 99% with said amino acid sequence or said partial sequence thereof.

The term "several" as used herein means an integer of about 10, 9, 8, 7, 6, 5, 4, 3, or 2.

As used herein, the "% identity" can be determined by using a protein or gene searching system such as BLAST or FASTA as mentioned above, with or without introducing a gap (Karlin, S. et al., 1993, Proceedings of the National Academic Sciences, U.S.A., vol. 90, pp. 5873-5877; Altschul, S. F. et al., 1990, Journal of Molecular Biology, vol. 215, pp. 403-410; Pearson, W. R. et al., 1988, Proceedings of the National Academic Sciences, U.S.A., vol. 85, pp. 2444-2448).

As used herein, the term "derivative" in case of a nucleic acid refers to a derivative labeled with fluorophore or the like, a derivative comprising a modified nucleotide (e.g., a nucleotide having a functional group such as halogen, alkyl (e.g., methyl), alkoxy (e.g., methoxy), thio, or carboxymethyl; or a nucleotide comprising, for example, reconstitution of a base, saturation of a double bond, deamination, or substitution of oxygen by sulfur), or the like. On the other hand, a "derivative" in case of a protein refers to a derivative labeled with an enzyme, fluorophore, or radioisotope, or a chemically modified derivative, such as an acetylated, acylated, alkylated, phosphorylated, sulfated, or glycosylated derivative.

As used herein, the term "a composition for diagnosis" or "a composition for determining the disease" refers to a composition that is directly or indirectly employed for diagnosing, detecting, determining, or predicting the presence or absence of the development or metastasis (or a possibility of metastasis) of esophageal cancer, the degree of advancement, or the degree of amelioration (i.e., whether this disease is ameliorated or is not ameliorated), or for screening for candidate substances useful for preventing, ameliorating, or treating esophageal cancer. The composition comprises a nucleotide, an oligonucleotide, or a polynucleotide, which can specifically recognize and bind to a gene whose expression varies or fluctuates in vivo, in particularly an esophagus tissue, associated with the development or metastasis of the esophageal cancer, or an antibody that can detect a protein as a translation product of the gene. Such nucleotide, oligonucleotide and polynucleotide can be effectively used as a probe for detecting the aforementioned gene that is expressed in vivo, in tissue, or in a cell, based on the aforementioned properties, or as a primer for amplifying the gene expressed in vivo.

As used herein, the term "biological tissue" to be detected or diagnosed refers to a tissue in which the expression pattern of the gene of the invention changes with the development of esophageal cancer. More specifically, the tissue means an esophageal tissue, peripheral lymph nodes, or another organ suspected of metastasis.

As used herein, the "biological sample" to be detected or diagnosed refers to a sample from a living body comprising or being suspected of comprising the target polypeptide that appears accompanied with the development of esophageal cancer.

The term "specifically bind(s)" as used herein means that an antibody or a fragment thereof forms an antigen-antibody complex with only the target polypeptide, or a mutant or fragment thereof, of the invention, but does not substantially form such a complex with other peptidic or polypeptidic substances. The term "substantially" as used herein means that formation of a nonspecific complex may occur if its degree is small.

The term "epitope" as used herein refers to an antigenic or immunogenic partial amino acid region (or an antigenic determinant) of the target polypeptide, or a mutant or fragment thereof, of the invention. The epitope is generally composed of at least 5 amino acids, preferably at least 7 amino acids, and more preferably at least 10 amino acids.

The term "AXL gene" or "AXL" as used herein includes a gene (or DNA) encoding the AXL receptor Tyrosine Kinase gene (or DNA) as shown in a given nucleotide sequence (i.e., SEQ ID NO: 1), a homolog thereof, a mutant thereof, a derivative thereof, or the like, unless it is defined by a SEQ ID NO. Specifically, it includes the AXL gene (GenBank Accession No. NM_021913) as shown in SEQ ID NO: 1 and homologs thereof derived from other organism species. The AXL gene can be obtained by the method disclosed in O'Bryan, J. P. et al., 1991, Molecular Cellar Biology, vol. 11, pp. 5016-5031.

The term "C6orf54 gene" or "C6orf54" as used herein includes a gene (or DNA) encoding the Chromosome 6 open reading frame 54 gene (or DNA) as shown in a given nucleotide sequence (i.e., SEQ ID NO: 2), a homolog thereof, a mutant thereof, a derivative thereof, or the like, unless it is defined by a SEQ ID NO. Specifically, it includes the C6orf54 gene as shown in SEQ ID NO: 2 (GenBank Accession No. NM_014354) and homologs thereof derived from other organism species. The C6orf54 gene can be obtained by the method disclosed in Minaguchi, T. et al., 1999, DNA Research, vol. 6, pp. 131-136.

The term "ZBTB11 gene" or "ZBTB11" as used herein includes a gene (or DNA) encoding the zinc finger and BTB Domain Containing 11 gene (or DNA) as shown in a given nucleotide sequence (i.e., SEQ ID NO: 3), a homolog thereof, a mutant thereof, a derivative thereof, or the like, unless it is defined by a SEQ ID NO. Specifically, it includes the ZBTB11 gene as shown in SEQ ID NO: 3 (GenBank Accession No. NM_014415) and homologs thereof derived from other organism species. The ZBTB11 gene was cloned in 1996 by Tang, C. M. et al.

The term "TNFRSF14 gene" or "TNFRSF14" as used herein includes a gene (or DNA) encoding the tumor necrosis Factor receptor superfamily, member 14 gene (or DNA) as shown in a given nucleotide sequence (i.e., SEQ ID NO: 4), a homolog thereof, a mutant thereof, a derivative thereof, or the like, unless it is defined by a SEQ ID NO. Specifically, it includes the TNFRSF14 gene as shown in SEQ ID NO: 4 (GenBank Accession No. NM_003820) and homologs thereof derived from other organism species. The TNFRSF14 gene can be obtained by the method disclosed in Montgomery, R. I. et al., 1996, Cell, vol. 87, pp. 427-436.

The term "NSUN5 gene" or "NSUN5" as used herein includes a gene (or DNA) encoding the NOL1/NOP2/Sun Domain family member 5 gene (or DNA) as shown in a given nucleotide sequence (i.e., SEQ ID NO: 5), a homolog thereof, a mutant thereof, a derivative thereof, or the like, unless it is defined by a SEQ ID NO. Specifically, it includes the NSUN5 gene as shown in SEQ ID NO: 5 (GenBank Accession No. NM_018044) and homologs thereof derived from other organism species. The NSUN5 gene can be obtained by the method disclosed in Doll, A. et al., 2001, Cytogenetics and Cell genetics, vol. 95, pp. 20-27.

The term “SPEN gene” or “SPEN” as used herein includes a gene (or DNA) encoding the spen homolog, transcriptional regulator gene (or DNA) as shown in a given nucleotide sequence (i.e., SEQ ID NO: 6), a homolog thereof, a mutant thereof, a derivative thereof, or the like, unless it is defined by a SEQ ID NO. Specifically, it includes the SPEN gene as shown in SEQ ID NO: 6 (GenBank Accession No. NM_015001) and homologs thereof derived from other organism species. The SPEN gene can be obtained by the method disclosed in Newberry, E. P et al., 1999, Biochemistry, vol. 38, pp. 10678-10690.

The term “LTBP3 gene” or “LTBP3” as used herein includes a gene (or DNA) encoding the latent transforming growth Factor Beta binding Protein 3 gene (or DNA) as shown in a given nucleotide sequence (i.e., SEQ ID NO: 7), a homolog thereof, a mutant thereof, a derivative thereof, or the like, unless it is defined by a SEQ ID NO. Specifically it includes the LTBP3 gene as shown in SEQ ID NO: 7 (GenBank Accession No. NM_021070) and homologs thereof derived from other organism species. The SPEN gene can be obtained by the method disclosed in Yin, W. et al., 1995, Journal of Biological Chemistry, vol. 270, pp. 10147-10160.

The term “SYNGR1 gene” or “SYNGR1” as used herein includes a gene (or DNA) encoding the synaptogyrin 1 gene (or DNA) as shown in a given nucleotide sequence (i.e., SEQ ID NO: 8), a homolog thereof, a mutant thereof, a derivative thereof, or the like, unless it is defined by a SEQ ID NO. Specifically, it includes the SYNGR1 gene as shown in SEQ ID NO: 8 (GenBank Accession No. NM_004711) and homologs thereof derived from other organism species. The SYNGR1 gene can be obtained by the method disclosed in Kedra, D. et al., 1998, Human Genetics, vol. 103, pp. 131-141.

The term “ARL3 gene” or “ARL3” as used herein includes a gene (or DNA) encoding the ADP-ribosylation Factor-like 3 gene (or DNA) as shown in a given nucleotide sequence (i.e., SEQ ID NO: 9), a homolog thereof, a mutant thereof, a derivative thereof, or the like, unless it is defined by a SEQ ID NO. Specifically, it includes the ARL3 gene as shown in SEQ ID NO: 9 (GenBank Accession No. NM_004311) and homologs thereof derived from the other organism species. The SYNGR1 gene can be obtained by the method disclosed in Cavenagh, M. M. et al., 1994, Journal of Biological Chemistry, vol. 269, pp. 18937-18942.

The term “SLC13A1 gene” or “SLC13A1” as used herein includes a gene or DNA) encoding the solute carrier family 13 (sodium/sulfate symporters), member 1 gene (or DNA) as shown in a given nucleotide sequence (i.e., SEQ ID NO: 10), a homolog thereof, a mutant thereof, a derivative thereof, or the like, unless it is defined by a SEQ ID NO. Specifically, it includes the SLC13A1 gene as shown in SEQ ID NO: 10 (GenBank Accession No. NM_022444) and homologs thereof derived from other organism species. The SLC13A1 gene can be obtained by the method disclosed in Lee, A. et al., 2000, Genomics, vol. 70, pp. 354-363.

The term “RALGDS gene” or “RALGDS” as used herein includes a gene (or DNA) encoding the ral guanine nucleotide dissociation stimulator gene (or DNA) as shown in a given nucleotide sequence (i.e., SEQ ID NO: 11), a homolog thereof, a mutant thereof, a derivative thereof, or the like, unless it is defined by a SEQ ID NO. Specifically, it includes the RALGDS gene as shown in SEQ ID NO: 11 (GenBank Accession No. NM_006266) and homologs thereof derived from the other organism species. The RALGDS gene can be obtained by the method disclosed in Albright, C. F. et al., 1993, EMBO Journal, vol. 12, pp. 339-347.

The term “ADD3 gene” or “ADD3” as used herein includes a gene (or DNA) encoding the adducin 3 (gamma) gene (or DNA) as shown in a given nucleotide sequence (i.e., SEQ ID NO: 12), a homolog thereof, a mutant thereof, a derivative thereof, or the like, unless it is defined by a SEQ ID NO. Specifically, it includes the ADD3 gene as shown in SEQ ID NO: 12 (GenBank Accession No. NM_019903) and homologs thereof derived from other organism species. The RADD3 gene can be obtained by the method disclosed in Katagiri, T. et al., 1996, Cytogenetics and Cell genetics, vol. 74, pp. 90-95.

The term “MAP3K12 gene” or “MAP3K12” as used herein includes a gene (or DNA) encoding the mitogen-activated Protein kinase kinase kinase12 gene (or DNA) as shown in a given nucleotide sequence (i.e., SEQ ID NO: 13), a homolog thereof, a mutant thereof, a derivative thereof, or the like, unless it is defined by a SEQ ID NO. Specifically, it includes the MAP3K12 gene as shown in SEQ ID NO: 13 (GenBank Accession No. NM_006301) and homologs thereof derived from other organism species. The MAP3K12 gene can be obtained by the method disclosed in Reddy, U. R. et al., 1994, Biochemical Biophysical Research Communications, vol. 202, pp. 613-620.

The term “AVPI1 gene” or “AVPI1” as used herein includes a gene (or DNA) encoding the arginine vasopressin-induced 1 gene (or DNA) as shown in a given nucleotide sequence (i.e., SEQ ID NO: 14), a homolog thereof, a mutant thereof, a derivative thereof, or the like, unless it is defined by a SEQ ID NO. Specifically, it includes the AVPI1 gene as shown in SEQ ID NO: 14 (GenBank Accession No. NM_021732) and homologs thereof derived from other organism species. The AVPI1 gene can be obtained by the method disclosed in Nicod, M. et al., 2002, EMBO Journal, vol. 21, pp. 5109-5117.

The term “GIMAP6 gene” or “GIMAP6” as used herein includes a gene (or DNA) encoding the GTPase, IMAP family member 6 gene (or DNA) as shown in a given nucleotide sequence (i.e., SEQ ID NO: 15), a homolog thereof, a mutant thereof, and a derivative thereof, unless it is defined by a SEQ ID NO. Specifically, it includes the GIMAP6 gene as shown in SEQ ID NO: 15 (GenBank Accession No. NM_024711) and homologs thereof derived from other organism species. The GIMAP6 gene can be obtained by the method disclosed in Stamm, O. et al., 2002, Gene, vol. 282, p 159-167.

The term “FLJ11259 gene” or “FLJ11259” as used herein includes a gene (or DNA) encoding the FLJ11259 gene (or DNA) as shown in a given nucleotide sequence (i.e., SEQ ID NO: 16), a homolog thereof, a mutant thereof, a derivative thereof, or the like, unless it is defined by a SEQ ID NO. Specifically, it includes the FLJ11259 gene as shown in SEQ ID NO: 16 (GenBank Accession No. NM_018370) and homologs thereof derived from other organism species. The FLJ11259 gene can be obtained by the method disclosed in Ota, T. et al., 2002, Nature Genetics, vol. 36, pp. 40-45.

The term “C3AR1 gene” or “C3AR1” as used herein includes a gene (or DNA) encoding the complement Component 3R receptor 1 gene (or DNA) as shown in a given nucleotide sequence (i.e., SEQ ID NO: 17), a homolog thereof, a mutant thereof, a derivative thereof, or the like, unless it is defined by a SEQ ID NO. Specifically, it includes the C3AR1 gene as shown in SEQ ID NO:17 (GenBank Accession No. NM_004054) and homologs thereof derived from other organism species. The C3AR1 gene can be obtained by the method disclosed in Ames, R. S. et al., 1996, Journal of Biological Chemistry, vol. 271, pp. 20231-20234.

The term “PCGF2 gene” or “PCGF2” as used herein includes a gene (or DNA) encoding the polycomb group ring finger 2 gene (or DNA) as shown in a given nucleotide sequence (i.e., SEQ ID NO: 18), a homolog thereof, a mutant thereof, a derivative thereof, or the like, unless it is defined by a SEQ ID NO. Specifically, it includes the PCGF2 gene as shown in SEQ ID NO: 18 (GenBank Accession No. NM_007144) and homologs thereof derived from the other organism species. The PCGF2 gene can be obtained by the method disclosed in Tagawa, M. et al., 1990, Journal of Biological Chemistry, vol. 265, pp. 20021-20026.

The term “PDE6D gene” or “PDE6D” as used herein includes a gene (or DNA) encoding the phosphodiesterase 6D, cGMP-Specific, rod, delta gene (or DNA) as shown in a given nucleotide sequence (i.e., SEQ ID NO: 19), a homolog thereof, a mutant thereof, a derivative thereof, or the like, unless it is defined by a SEQ ID NO. Specifically, it includes the PDE6D gene as shown in SEQ ID NO: 19 (GenBank Accession No. NM_002601) and homologs thereof derived from other organism species. The PDE6D gene can be obtained by the method disclosed in Florio, S. K. et al., 1996, Journal of Biological Chemistry, vol. 271, pp. 24036-24047.

The term “PLCG2 gene” or “PLCG2” as used herein includes a gene (or DNA) encoding the phospholipase C, gamma 2 gene (or DNA) as shown in a given nucleotide sequence (i.e., SEQ ID NO: 20), a homolog thereof, a mutant thereof, a derivative thereof, or the like, unless it is defined by a SEQ ID NO. Specifically, it includes the PLCG2 gene as shown in SEQ ID NO: 20 (GenBank Accession No. NM_002661) and homologs thereof derived from other organism species. The PLCG2 gene can be obtained by the method disclosed in Kang, J. S. et al., 1996, FEBBS Letters, vol. 399, pp. 14-20.

The term “GPR148 gene” or “GPR148” as used herein includes a gene (or DNA) encoding the g Protein-coupled receptor 148 gene (or DNA) as shown in a given nucleotide sequence (i.e., SEQ ID NO: 21), a homolog thereof, a mutant thereof, a derivative thereof, or the like, unless it is defined by a SEQ ID NO. Specifically, it includes the GPR148 gene as shown in SEQ ID NO: 21 (GenBank Accession No. NM_207364) and homologs thereof derived from other organism species. The GPR148 gene can be obtained by the method disclosed in Vassilatis, D. K. et al., 2003, Proceedings of the National Academy of Sciences of the United States of America, vol. 100, pp. 4903-4908.

The term “ARF6 gene” or “ARF6” as used herein includes a gene (or DNA) encoding the ADP-ribosylation Factor 6 gene (or DNA) as shown in a given nucleotide sequence (i.e., SEQ ID NO: 22), a homolog thereof, a mutant thereof, a derivative thereof, or the like, unless it is defined by a SEQ ID NO. Specifically, it includes the ARF6 gene as shown in SEQ ID NO: 22 (GenBank Accession No. NM_001663) and homologs thereof derived from other organism species. The ARF6 gene can be obtained by the method disclosed in Cavenagh, M. M. et al., 1996, Journal of Biological Chemistry, vol. 271, pp. 21767-21774.

The term “NISCH gene” or “NISCH” as used herein includes a gene (or DNA) encoding the nischarin gene (or DNA) as shown in a given nucleotide sequence (i.e., SEQ ID NO: 23), a homolog thereof, a mutant thereof, a derivative thereof or the like, unless it is defined by a SEQ ID NO. Specifically, it includes the NISCH gene as shown in SEQ ID NO: 23 (GenBank Accession No. NM_007184) and homologs thereof derived from other organism species. The NISCH gene can be obtained by the method disclosed in Ivanov, T. R. et al., 1998, Journal of the Autonomic Nervous System, vol. 72, pp. 98-110.

The term “GLYAT gene” or “GLYAT” as used herein includes a gene (or DNA) encoding the glycine-N-acyltransferase gene (or DNA) as shown in a given nucleotide sequence (i.e., SEQ ID NO: 24), a homolog thereof a mutant thereof, a derivative thereof or the like, unless it is defined by a SEQ ID NO. Specifically, it includes the GLYAT gene as shown in SEQ ID NO: 24 (GenBank Accession No. NM_005838) and homologs thereof derived from other organism species. The GLYAT gene can be obtained by the method disclosed in Schachter, D. et al., 1976, Journal of Biological Chemistry, vol. 251, pp. 3352-3358.

The term “IGHM gene” or “IGHM” as used herein includes a gene (or DNA) encoding the immunoglobulin heavy constant mu gene (or DNA) as shown in a given nucleotide sequence (i.e., SEQ ID NO: 25), a homolog thereof, a mutant thereof, a derivative thereof or the like, unless it is defined by a SEQ ID NO. Specifically, it includes the IGHM gene as shown in SEQ ID NO: 25 (GenBank Accession No. NG_001019) and homologs thereof derived from other organism species. The IGHM gene can be obtained by the method disclosed in Ravetch, J. V. et al., 1981, Cell, vol. 27, pp. 583-591.

The term “FBXO38 gene” or “FBXO38” as used herein includes a gene (or DNA) encoding the F-box Protein 38 gene (or DNA) as shown in a given nucleotide sequence (i.e., SEQ ID NO: 26), a homolog thereof, a mutant thereof a derivative thereof, or the like, unless it is defined by a SEQ ID NO. Specifically, it includes the FBXO38 gene as shown in SEQ ID NOs: 26 (GenBank Accession No. NM_205836) and homologs thereof derived from other organism species. The FBXO38 gene can be obtained by the method disclosed in Smaldone, S. et al., 2004, Molecular and cellular Biology, vol. 24, pp. 1058-1069.

The term “SLC12A1 gene” or “SLC12A1” as used herein includes a gene (or DNA) encoding the solute carrier family 12 (sodium/potassium/chloride transporters), member 1 gene (or DNA) as shown in a given nucleotide sequence (i.e., SEQ ID NO: 27), a homolog thereof, a mutant thereof, a derivative thereof, or the like, unless it is defined by a SEQ ID NO. Specifically, it includes the SLC12A1 gene as shown in SEQ ID NO: 27 (GenBank Accession No. NM_000338) and homologs thereof derived from other organism species. The SLC12A1 gene can be obtained by the method disclosed in Simon, D. B. et al., 1996, Nature Genetics, vol. 13, pp. 183-188.

The term “PGDS gene” or “PGDS” as used herein includes a gene (or DNA) encoding the prostaglandin D2 synthase, hematopoietic gene (or DNA) as shown in a given nucleotide sequence (i.e., SEQ ID NO: 28), a homolog thereof, a mutant thereof, a derivative thereof, or the like, unless it is defined by a SEQ ID NO. Specifically, it includes the PGDS gene as shown in SEQ ID NO: 28 (GenBank Accession No. NM_014485) and homologs thereof derived from other organism species. The PGDS gene can be obtained by the method disclosed in Kanaoka, Y et al., 1997, Cell, vol. 90, pp. 1085-1095.

The term “CD48 gene” or “CD48” as used herein includes a gene (or DNA) encoding the CD48 antigen gene (or DNA) as shown in a given nucleotide sequence (i.e., SEQ ID NO: 29), a homolog thereof, a mutant thereof, a derivative thereof, or the like, unless it is defined by a SEQ ID NO. Specifically, it includes the CD48 gene as shown in SEQ ID NO: 29 (GenBank Accession No. NM_001778) and homologs thereof derived from other organism species. The CD48 gene can be obtained by the method disclosed in Staunton, D. E. et al., 1987, EMBO Journal, vol. 6, pp. 3695-3701.

The term "IMPA2 gene" or "IMPA2" as used herein includes a gene (or DNA) encoding the inositol (myo)-1 (or 4)-monophosphatase 2 gene (or DNA) as shown in a given nucleotide sequence (i.e., SEQ ID NO: 30), a homolog thereof, a mutant thereof, a derivative thereof, or the like, unless it is defined by a SEQ ID NO. Specifically, it includes the IMPA2 gene as shown in SEQ ID NO: 30 (GenBank Accession No. NM_014214) and homologs thereof derived from other organism species. The IMPA2 gene can be obtained by the method disclosed in Yoshikawa, T. et al., 1997, Molecular psychiatry, vol. 2, pp. 393-397.

The term "HSPA6 gene" or "HSPA6" as used herein includes a gene (or DNA) encoding the heat shock 70 kDa protein 6 (HSP70B') gene (or DNA) as shown in a given nucleotide sequence (i.e., SEQ ID NO: 31), a homolog thereof, a mutant thereof, a derivative thereof, or the like, unless it is defined by a SEQ ID NO. Specifically, it includes the HSPA6 gene as shown in SEQ ID NO: 31 (GenBank Accession No. NM_002155) and homologs thereof derived from other organism species. The HSPA6 gene can be obtained by the method disclosed in Voellmy, R. et al., 1985, Proceedings of the National Academy of Sciences of the United States of America, vol. 82, pp. 4949-4953.

The term "EIF3S9 gene" or "EIF3S9" as used herein includes a gene (or DNA) encoding the eukaryotic Translation initiation Factor 3, Subunit 9 eta, 116 kDa gene (or DNA) as shown in a given nucleotide sequence (i.e., SEQ ID NO: 32), a homolog thereof, a mutant thereof, a derivative thereof, or the like, unless it is defined by a SEQ ID NO. Specifically, it includes the EIF3S9 gene as shown in SEQ ID NO: 32 (GenBank Accession No. NM_003751) and homologs thereof derived from other organism species. The EIF3S9 gene can be obtained by the method disclosed in Methot, N. et al., 1997, Journal of Biological Chemistry, vol. 272, pp. 1110-1116.

The term "ZNF659 gene" or "ZNF659" as used herein includes a gene (or DNA) encoding the zinc finger Protein 659 gene (or DNA) as shown in a given nucleotide sequence (i.e., SEQ ID NO: 33), a homolog thereof, a mutant thereof, a derivative thereof, or the like, unless it is defined by a SEQ ID NO. Specifically, it includes the ZNF659 gene as shown in SEQ ID NO: 33 (GenBank Accession No. NM_024697) and homologs thereof derived from other organism species. The ZNF659 gene was cloned in 2000 by Sugano, S. et al.

The term "RAB6C gene" or "RAB6C" as used herein includes a gene (or DNA) encoding the RAB6C, member RAS oncogene family gene (or DNA) as shown in a given nucleotide sequence (i.e., SEQ ID NO: 34), a homolog thereof, a mutant thereof, a derivative thereof, or the like, unless it is defined by a SEQ ID NO. Specifically, it includes the RAB6C gene as shown in SEQ ID NO: 34 (GenBank Accession No. NM_032144) and homologs thereof derived from other organism species. The RAB6C gene can be obtained by the method disclosed in Fitzgerald, M. L. et al., 1999, Biochemical Journal, vol. 342, pp. 353-360.

The term "NOL1 gene" or "NOL1" as used herein includes a gene (or DNA) encoding the nucleolar Protein 1, 120 kDa gene (or DNA) as shown in a given nucleotide sequence (i.e., SEQ ID NO: 35), a homolog thereof, a mutant thereof, a derivative thereof, or the like, unless it is defined by a SEQ ID NO. Specifically, it includes the NDL1 gene as shown in SEQ ID NO: 35 (GenBank Accession No. NM_006170) and homologs thereof derived from other organism species. The NOL1 gene can be obtained by the method disclosed in Freeman, J. W. et al., 1988, Cancer Research, vol. 48, pp. 1244-1251.

The term "DAB2 gene" or "DAB2" as used herein includes a gene (or DNA) encoding the disabled homolog 2, mitogen-responsive Phosphoprotein gene (or DNA) as shown in a given nucleotide sequence (i.e., SEQ ID NO: 36), a homolog thereof, a mutant thereof, a derivative thereof, or the like, unless it is defined by a SEQ ID NO. Specifically, it includes the DAB2 gene as shown in SEQ ID NO: 36 (GenBank Accession No. NM_001343) and homologs thereof derived from other organism species. The DAB2 gene can be obtained by the method disclosed in Mok, S. C. et al., 1994, Gynecologic oncology, vol. 52, pp. 247-252.

The term "EBI3 gene" or "EBI3" as used herein includes a gene (or DNA) encoding the Epstein-Barr virus induced Gene 3 gene (or DNA) as shown in a given nucleotide sequence (i.e., SEQ ID NO: 37), a homolog thereof, a mutant thereof, a derivative thereof, or the like, unless it is defined by a SEQ ID NO. Specifically, it includes the EBI3 gene as shown in SEQ ID NO: 37 (GenBank Accession No. NM_005755) and homologs thereof derived from other organism species. The EBI3 gene can be obtained by the method disclosed in Devergne, O. et al., 1996, Journal of virology, vol. 70, pp. 1143-1153.

The term "PRSS3 gene" or "PRSS3" as used herein includes a gene (or DNA) encoding the protease, Serine, 3 (mesotrypsin) gene (or DNA) as shown in a given nucleotide sequence (i.e., SEQ ID NO: 38), a homolog thereof, a mutant thereof, a derivative thereof, or the like, unless it is defined by a SEQ ID NO. Specifically, it includes the PRSS3 gene as shown in SEQ ID NO: 38 (GenBank Accession No. NM_002771) and homologs thereof derived from other organism species. The PRSS3 gene can be obtained by the method disclosed in Robinson, M. A. et al., 1993, Proceedings of the National Academy of Sciences of the United States of America, vol. 90, pp. 2433-2437.

The term "GLB1 gene" or "GLB1" as used herein includes a gene (or DNA) encoding the galactosidase, Beta 1 gene (or DNA) as shown in a given nucleotide sequence (i.e., SEQ ID NO: 39), a homolog thereof, a mutant thereof, a derivative thereof, or the like, unless it is defined by a SEQ ID NO. Specifically, it includes the GLB1 gene as shown in SEQ ID NO: 39 (GenBank Accession No. NM_000404) and homologs thereof derived from other organism species. The GLB1 gene can be obtained by the method disclosed in Shows, T. B. et al., 1979, Somatic Cell Genetics, vol. 5, pp. 147-158.

The term "SAMSN1 gene" or "SAMSN1" as used herein includes a gene (or DNA) encoding the SAM Domain, SH3 Domain and nuclear localization signals, 1 gene (or DNA) as shown in a given nucleotide sequence (i.e., SEQ ID NO: 40), a homolog thereof, a mutant thereof, a derivative thereof, or the like, unless it is defined by a SEQ ID NO. Specifically, it includes the SAMSN1 gene as shown in SEQ ID NO: 40 (GenBank Accession No. NM_022136) and homologs thereof derived from other organism species. The SAMSN1 gene can be obtained by the method disclosed in Claudio, J. O. et al., 2001, Oncogene, vol. 20, pp. 5373-5377.

The term "AQP3 gene" or "AQP3" as used herein includes a gene (or DNA) encoding the aquaporin 3 gene (or DNA) as shown in a given nucleotide sequence (i.e., SEQ ID NO: 41), a homolog thereof, a mutant thereof, a derivative thereof, or the like, unless it is defined by a SEQ ID NO. Specifically, it includes the AQP3 gene as shown in SEQ ID NO: 41 (GenBank Accession No. NM_004925) and homologs thereof derived from other organism species. The AQP3 gene can be obtained by the method disclosed in Ishibashi, K. et al., 1994, Proceedings of the National Academy of Sciences of the United States of America, vol. 91, pp. 6269-6273.

The term "CAPZA2 gene" or "CAPZA2" as used herein includes a gene (or DNA) encoding the capping Protein (actin filament) muscle Z-line, alpha 2 gene (or DNA) as shown in a given nucleotide sequence (i.e., SEQ ID NO: 42), a homolog thereof, a mutant thereof, a derivative thereof, or the like, unless it is defined by a SEQ ID NO. Specifically, it includes the CAPZA2 gene as shown in SEQ ID NO: 42 (GenBank Accession No. NM_006136) and homologs thereof derived from other organism species. The CAPZA2 gene can be obtained by the method disclosed in Barron-Casella, E. A. et al., 1995, Journal of Biological Chemistry, vol. 270, pp. 21472-21479.

The term "B4GALT2 gene" or "B4GALT2" as used herein includes a gene (or DNA) encoding the UDP-Gal:beta-GlcNAc Beta 1,4-galactosyltransferase, Polypeptide 2 gene (or DNA) as shown in a given nucleotide sequence (i.e., SEQ ID NO: 43), a homolog thereof, a mutant thereof, a derivative thereof, or the like, unless it is defined by a SEQ ID NO. Specifically, it includes the B4GALT2 gene as shown in SEQ ID NO: 43 (GenBank Accession No. NM_003780) and homologs thereof derived from other organism species. The B4GALT2 gene can be obtained by the method disclosed in Almeida, R. et al., 1997, Journal of Biological Chemistry, vol. 272, pp. 31979-31991.

The term "ARHGEF3 gene" or "ARHGEF3" as used herein includes a gene (or DNA) encoding the Rho guanine nucleotide exchange Factor (GEF) gene (or DNA) as shown in a given nucleotide sequence (i.e., SEQ ID NO: 44), a homolog thereof, a mutant thereof, a derivative thereof, or the like, unless it is defined by a SEQ ID NO. Specifically, it includes the ARHGEF3 gene as shown in SEQ ID NO: 44 (GenBank Accession No. NM_019555) and homologs thereof derived from other organism species. The ARHGEF3 gene can be obtained by the method disclosed in Thiesen, S. et al., 2000, Biochemical and biophysical research communications, vol. 273, pp. 364-369.

The term "POGK gene" or "POGK" as used herein includes a gene (or DNA) encoding the pogo transposable element with KRAB Domain gene (or DNA) as shown in a given nucleotide sequence (i.e., SEQ ID NO: 45), a homolog thereof, a mutant thereof, a derivative thereof, or the like, unless it is defined by a SEQ ID NO. Specifically, it includes the POGK gene as shown in SEQ ID NO: 45 (GenBank Accession No. AB 040946) and homologs thereof derived from other organism species. The POGK gene can be obtained by the method disclosed in Greenhalf, W. et al., 1999, Yeast, vol. 15, pp. 1307-1321.

The term "PRAF1 gene" or "PRAF1" as used herein includes a gene (or DNA) encoding the polymerase (RNA) I associated Factor 1 gene (or DNA) as shown in a given nucleotide sequence (i.e., SEQ ID NO: 46), a homolog thereof, a mutant thereof, a derivative thereof, or the like, unless it is defined by a SEQ ID NO. Specifically, it includes the PRAF1 gene as shown in SEQ ID NO: 46 (GenBank Accession No. NM_022490) and homologs thereof derived from other organism species. The POGK gene can be obtained by the method disclosed in Hanada, K. et al., 1996, EMBO Journal, vol. 15, pp. 2217-2226.

The term "HPGD gene" or "HPGD" as used herein includes a gene (or DNA) encoding the hydroxyprostaglandin dehydrogenase 15-(NAD) gene (or DNA) as shown in a given nucleotide sequence (i.e., SEQ ID NO: 47), a homolog thereof, a mutant thereof, a derivative thereof, or the like, unless it is defined by a SEQ ID NO. Specifically, it includes the HPGD gene as shown in SEQ ID NO: 47 (GenBank Accession No. NM_000860) and homologs thereof derived from other organism species. The HPGD gene can be obtained by the method disclosed in Pichaud, F. et al., 1997, Human genetics, vol. 99, pp. 279-281. It is described in Kawamata, H. et al., 2003, Cancer Science, vol. 94, pp. 699-706 that the expression level of the HPGD gene is increased in the metastatic substrain of the established esophageal cancer cell line.

The term "GALNS gene" or "GALNS" as used herein includes a gene (or DNA) encoding the galactosamine (N-acetyl)-6-sulfate sulfatase gene (or DNA) as shown in a given nucleotide sequence (i.e., SEQ ID NO: 142), a homolog thereof, a mutant thereof, a derivative thereof, or the like, unless it is defined by a SEQ ID NO. Specifically, it includes the GALNS gene as shown in SEQ ID NO: 142 (GenBank Accession No. NM_000512) and homologs thereof derived from other organism species.

The term "fgf3 gene" or "fgf" as used herein includes a gene (or DNA) encoding the fibroblast growth factor 3 gene (or DNA) as shown in a given nucleotide sequence (i.e., SEQ ID NO: 143), a homolog thereof, a mutant thereof, a derivative thereof, or the like, unless it is defined by a SEQ ID NO. Specifically, it includes the fgf3 gene as shown in SEQ ID NO: 143 (GenBank Accession No. NM_005247) and homologs thereof derived from other organism species.

The term "CMK2B gene" or "CMK2B" as used herein includes a gene (or DNA) encoding the calcium/calmodulin-dependent protein kinase (CAM kinase) II beta gene (or DNA) as shown in a given nucleotide sequence (i.e., SEQ ID NO: 144), a homolog thereof, a mutant thereof, a derivative thereof, or the like, unless it is defined by a SEQ ID NO. Specifically, it includes the CMK2B gene as shown in SEQ ID NO: 144 (GenBank Accession No. NM_001220) and homologs thereof derived from other organism species.

The term "CAMKIINalpha gene" or "CAMKIINalpha" as used herein includes a gene (or DNA) encoding the calcium/calmodulin-dependent protein kinase II gene (or DNA) as shown in a given nucleotide sequence (i.e., SEQ ID NO: 145), a homolog thereof a mutant thereof, a derivative thereof, or the like, unless it is defined by a SEQ ID NO. Specifically, it includes the CAMKIIalpha gene as shown in SEQ ID NO: 145 (GenBank Accession No. NM_018584) and homologs thereof derived from other organism species.

The term "PSARL gene" or "PSARL" as used herein includes a gene (or DNA) encoding the Presenilin-associated rhomboid-like protein gene (or DNA) as shown in a given nucleotide sequence (i.e., SEQ ID NO: 146), a homolog thereof, a mutant thereof, a derivative thereof, or the like, unless it is defined by a SEQ ID NO. Specifically, it includes the PSARL gene as shown in SEQ ID NO: 146 (GenBank Accession No. NM_018622) and homologs thereof derived from other organism species.

The term "XRCC3 gene" or "XRCC3" as used herein includes a gene (or DNA) encoding the X-ray repair complementing defective repair in Chinese hamster cell 3 gene (or DNA) as shown in a given nucleotide sequence (i.e., SEQ ID NO: 147), a homolog thereof, a mutant thereof, a derivative thereof, or the like, unless it is defined by a SEQ ID NO. Specifically, it includes the XRCC3 gene as shown in SEQ ID NO: 147 (GenBank Accession No. NM_005432) and homologs thereof derived from other organism species.

The term "CAPG gene" or "CAPG" as used herein includes a gene (or DNA) encoding the capping protein (actin filament) gelsolin-like (CAPG) gene (or DNA) as shown in a given nucleotide sequence (i.e., SEQ ID NO: 148), a homolog thereof, a mutant thereof, a derivative thereof, or the like, unless it is defined by a SEQ ID NO. Specifically, it includes the CAPG gene as shown in SEQ ID NO: 148 (GenBank Accession No. NM_001747) and a homologs thereof derived from other organism species.

The term "GRHPR gene" or "GRHPR" as used herein includes a gene (or DNA) encoding the glyoxylate reductase/hydroxypyruvate reductase gene (or DNA) as shown in a given nucleotide sequence (i.e., SEQ ID NO: 149), a homolog thereof, a mutant thereof, a derivative thereof, or the like, unless it is defined by a SEQ ID NO. Specifically, it includes the GRHPR gene as shown in SEQ ID NO: 149 (GenBank Accession No. NM_012203) and homologs thereof derived from other organism species.

The term "TROAP gene" or "TROAP" as used herein includes a gene (or DNA) encoding the trophinin associated protein (tastin) gene (or DNA) as shown in a given nucleotide sequence (i.e., SEQ ID NO: 150), a homolog thereof, a mutant thereof, a derivative thereof, or the like, unless it is defined by a SEQ ID NO. Specifically, it includes the TROAP gene as shown in SEQ ID NO: 150 (GenBank Accession No. NM_005480) and a homologs thereof derived from other organism species.

The term "RRM2 gene" or "RRM2" as used herein includes a gene (or DNA) encoding the ribonucleotide reductase M2 gene (or DNA) as shown in a given nucleotide sequence (i.e., SEQ ID NO: 151), a homolog thereof, a mutant thereof, a derivative thereof, or the like, unless it is defined by a SEQ ID NO. Specifically, it includes the RRM2 gene as shown in SEQ ID NO: 151 (GenBank Accession No. NM_001034) and a homologs thereof derived from other organism species.

The term "SATB2 gene" or "SATB2" as used herein includes a gene (or DNA) encoding the SATB family member 2 gene (or DNA) as shown in a given nucleotide sequence (i.e., SEQ ID NO: 152), a homolog thereof, a mutant thereof, a derivative thereof, or the like, unless it is defined by a SEQ ID NO. Specifically, it includes the SATB2 gene as shown in SEQ ID NO: 152 (GenBank Accession No. NM_015265) and homologs thereof derived from other organism species.

The term "C14orf162 gene" or "C14orf162" as used herein includes a gene (or DNA) encoding the chromoseme 14 open reading frame 162 gene (or DNA) as shown in a given nucleotide sequence (i.e., SEQ ID NO: 153), a homolog thereof, a mutant thereof, a derivative thereof, or the like, unless it is defined by a SEQ ID NO. Specifically, it includes the C14orf162 gene as shown in SEQ ID NO: 153 (GenBank Accession No. NM_020181) and homologs thereof derived from other organism species.

The term "SEPT6 gene" or "SEPT6" as used herein includes a gene (or DNA) encoding the septin 6 gene (or DNA) as shown in a given nucleotide sequence (i.e., SEQ ID NO: 154), a homolog thereof, a mutant thereof, a derivative thereof, or the like, unless it is defined by a SEQ ID NO. Specifically, it includes the SEPT6 gene as shown in SEQ ID NO: 154 (GenBank Accession No. NM_145799) and homologs thereof derived from other organism species.

The term "M6PR gene" or "M6PR" as used herein includes a gene (or DNA) encoding the small mannose 6-phosphate receptor gene (or DNA) as shown in a given nucleotide sequence (i.e., SEQ ID NO: 155), a homolog thereof, a mutant thereof, a derivative thereof, or the like, unless it is defined by a SEQ ID NO. Specifically, it includes the M6PR gene as shown in SEQ ID NO: 155 (GenBank Accession No. NM_002355) and homologs thereof derived from other organism species.

The term "SPRR3 gene" or "SPRR3" as used herein includes a gene (or DNA) encoding the small proline-rich protein 3 gene (or DNA) as shown in a given nucleotide sequence (i.e., SEQ ID NO: 156), a homolog thereof, a mutant thereof, a derivative thereof, or the like, unless it is defined by a SEQ ID NO. Specifically, it includes the SPRR3 gene as shown in SEQ ID NO: 156 (GenBank Accession No. NM_005416) and homologs thereof derived from other organism species.

The term "EML1 gene" or "EML1" as used herein includes a gene (or DNA) encoding the Echinoderm microtubule-associated protein-like 1 gene (or DNA) as shown in a given nucleotide sequence (i.e., SEQ ID NO: 157), a homolog thereof, a mutant thereof, a derivative thereof, or the like, unless it is defined by a SEQ ID NO. Specifically, it includes the EML1 gene as shown in SEQ ID NO: 157 (GenBank Accession No. NM_004434) and homologs thereof derived from other organism species.

The term "YPEL5 gene" or "YPEL5" as used herein includes a gene (or DNA) encoding the yippee-like 5 (*Drosophila*) gene (or DNA) as shown in a given nucleotide sequence (i.e., SEQ ID NO: 158), a homolog thereof, a mutant thereof, and a derivative thereof, unless it is defined by a SEQ ID NO. Specifically, it includes the YPEL5 gene as shown in SEQ ID NO: 158 (GenBank Accession No. NM_016061) and homologs thereof derived from other organism species.

The term "EIF4EBP2 gene" or "EIF4EBP2" as used herein includes a gene (or DNA) encoding the Eukaryotic translation initiation factor 4E-binding protein 2 gene (or DNA) as shown in a given nucleotide sequence (i.e., SEQ ID NO: 159), a homolog thereof, a mutant thereof, a derivative thereof, or the like, unless it is defined by a SEQ ID NO. Specifically, it includes the EIF4EBP2 gene as shown in SEQ ID NO: 159 (GenBank Accession No. NM_004096) and homologs thereof derived from other organism species.

The term "SLC2A14 gene" or "SLC2A14" as used herein includes a gene (or DNA) encoding the Solute carrier family 2 (facilitated glucose transporter), member 14 gene (or DNA) as shown in a given nucleotide sequence (i.e., SEQ ID NO: 160), a homolog thereof, a mutant thereof, a derivative thereof, or the like, unless it is defined by a SEQ ID NO. Specifically, it includes the SLC2A14 gene as shown in SEQ ID NO: 160 (GenBank Accession No. BC060766) and homologs thereof derived from other organism species.

The term "SLIT2 gene" or "SLIT2" as used herein includes a gene (or DNA) encoding the *Drosophila*, SLIT2 gene (or DNA) as shown in a given nucleotide sequence (i.e., SEQ ID NO: 161), a homolog thereof, a mutant thereof, a derivative thereof, or the like, unless it is defined by a SEQ ID NO. Specifically, it includes the SLIT2 gene as shown in SEQ ID NO: 161 (GenBank Accession No. NM_004787) and homologs thereof derived from other organism species.

ADVANTAGE OF THE INVENTION

The present invention provides a composition for determining the disease, i.e. esophageal cancer or metastasis of esophageal cancer, wherein the composition is useful for diagnosing, detecting, determining, or predicting the esophageal cancer or the metastasis of esophageal cancer, and for treating the esophageal cancer. The present invention further provides a method for diagnosing, detecting, determining, or predicting the esophageal cancer and the metastasis of esophageal cancer, using said composition. Use of the composition produces a remarkable advantage that is to provide a simple, highly predictable, rapid and simple method for detecting, determining, or predicting the esophageal cancer or the metastasis of esophageal cancer.

Some of the esophageal cancer markers of the invention can be observed in biological samples, such as blood, from patients with esophageal cancer; however, they are not or almost not found in healthy persons. For this reason, using the presence or amount of such markers as an indicator enables easy detection of esophageal cancer in the blood, for example.

PREFERRED EMBODIMENTS OF THE INVENTION

Figure 1:
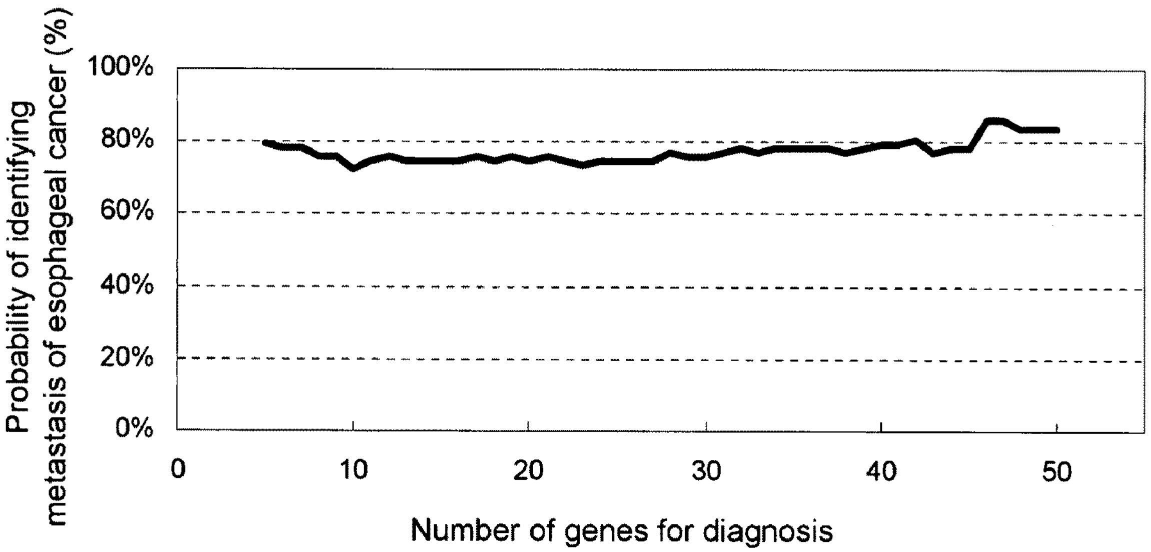
FIG. 1 shows a detection rate of the presence of metastatic esophageal cancer cells by using any combination of the polynucleotides as shown in SEQ ID NOS: 48 to 94, which are corresponding to the genes described in Table 2. The vertical axis shows the probability of detecting the presence of a metastatic esophageal cancer tissue in the specimen; and the horizontal axis shows the total number of genes required for detecting metastatic esophageal cancer and increased in order, in the SEQ ID NOs. of the Table 2.

Hereafter, the present invention is described in more detail.

1. Esophageal Cancer-Associated Markers 1.1 Esophageal Cancer-Associated Target Nucleic Acids (1)

Examples of target nucleic acids as markers associated with the metastasis of esophageal cancer for detecting, determining, or predicting the presence or metastasis of esophageal cancer using the composition, kit, or DNA chip of the present invention include human genes each comprising a nucleotide sequence as shown in any of SEQ ID NOS: 1 to 47 (i.e., AXL, C6orf54, ZBTB11, TNFRSF14, NSUN5, SPEN, LTBP3, SYNGR1, ARL3, SLC13A1, RALGDS, ADD3, MAP3K12, AVPI1, GIMAP6, FLJ11259, C3AR1, PCGF2, PDE6D, PLCG2, GPR148, ARF6, NISCH, GLYAT, IGHM, FBXO38, SLC12A1, PGDS, CD48, IMPA2, HSPA6, EIF3S9, ZNF659, RAB6C, NOL1, DAB2, EBI3, PRSS3, GLB1, SAMSN1, AQP3, CAPZA2, B4GALT2, ARHGEF3, POGK, PRAF1, and HPGD, respectively), homologs thereof, transcription products or cDNAs thereof, mutants thereof, and derivatives thereof. The terms "gene," "homolog," "transcription product," "cDNA," "mutant," and "derivative" are as defined above. The preferred target nucleic acids are human genes, each of which comprises a nucleotide sequence as shown in any of SEQ ID NOS: 1 to 47, and transcription products or cDNAs thereof, preferably transcription products or cDNAs.

According to the present invention, the expression levels of said genes, a target of the metastasis of esophageal cancer, significantly change (i.e., increase or decrease) in the esophageal cancer tissues from the patients in which the lymph node metastasis was not observed at surgery, when compared with the esophageal cancer tissues from patients with lymph node metastasis observed at surgery.

The 1st target nucleic acids are the AXL gene, homologs thereof, transcription products or cDNAs thereof, mutants thereof, or derivatives thereof. Up to the present, there has been no report that the decreased expression of the AXL gene and transcription product thereof could function as an esophageal cancer marker.

The 2nd target nucleic acids are the C6orf54 gene, homologs thereof, transcription products or cDNAs thereof, mutants thereof, or derivatives thereof. Up to the present, there has been no report that the decreased expression of the C6orf54 gene and transcription product thereof could function as an esophageal cancer marker.

The 3rd target nucleic acids are the ZBTB11 gene, homologs thereof, transcription products or cDNAs thereof, mutants thereof, or derivatives thereof. Up to the present, there has been no report that the decreased expression of the ZBTB11 gene and transcription product thereof could function as an esophageal cancer marker.

The 4th target nucleic acids are the TNFRSF14 gene, homologs thereof, transcription products or cDNAs thereof, mutants thereof, or derivatives thereof. Up to the present, there has been no report that the decreased expression of the TNFRSF14 gene and transcription product thereof could function as an esophageal cancer marker.

The 5th target nucleic acids are the NSUN5 gene, homologs thereof, transcription products or cDNAs thereof, mutants thereof, or derivatives thereof. Up to the present, there has been no report that the decreased expression of the NSUN5 gene and transcription product thereof could function as an esophageal cancer marker.

The 6th target nucleic acids are the SPEN gene, homologs thereof, transcription products or cDNAs thereof, mutants thereof, or derivatives thereof. Up to the present, there has been no report that the decreased expression of the SPEN gene and transcription product thereof could function as an esophageal cancer marker.

The 7th target nucleic acids are the LTBP3 gene, homologs thereof, transcription products or cDNAs thereof, mutants thereof, or derivatives thereof. Up to the present, there has been no report that the decreased expression of the LTBP3 gene and transcription product thereof could function as an esophageal cancer marker.

The 8th target nucleic acids are the SYNGR1 gene, homologs thereof, transcription products or cDNAs thereof, mutants thereof, or derivatives thereof. Up to the present, there has been no report that the decreased expression of the SYNGR1 gene and transcription products thereof could function as an esophageal cancer marker.

The 9th target nucleic acids are the ARL3 gene, homologs thereof, transcription products or cDNAs thereof, mutants thereof, or derivatives thereof. Up to the present, there has been no report that the decreased expression of the ARL3 gene and transcription product thereof could function as an esophageal cancer marker.

The 10th target nucleic acids are the SLC13A1 gene, homologs thereof, transcription products or cDNAs thereof, mutants thereof, or derivatives thereof. Up to the present, there has been no report that the decreased expression of the SLC13A1 gene and transcription product thereof could function as an esophageal cancer marker.

The 11th target nucleic acids are the RALGDS gene, homologs thereof, transcription products or cDNAs thereof, mutants thereof, or derivatives thereof. Up to the present, there has been no report that the decreased expression of the RALGDS gene and transcription product thereof could function as an esophageal cancer marker.

The 12th target nucleic acids are the ADD3 gene, homologs thereof, transcription products or cDNAs thereof, mutants thereof, or derivatives thereof. Up to the present, there has been no report that the decreased expression of the ADD3 gene and transcription product thereof could function as an esophageal cancer marker.

The 13th target nucleic acids are the MAP3K12 gene, homologs thereof, transcription products or cDNAs thereof, mutants thereof, or derivatives thereof. Up to the present, there has been no report that the decreased expression of the MAP3K12 gene and transcription product thereof could function as an esophageal cancer marker.

The 14th target nucleic acids are the AVPI1 gene, homologs thereof, transcription products or cDNAs thereof, mutants thereof, or derivatives thereof. Up to the present, there has been no report that the decreased expression of the AVPI1 gene and transcription product thereof could function as an esophageal cancer marker.

The 15th target nucleic acids are the GIMAP6 gene, homologs thereof, transcription products or cDNAs thereof, mutants thereof, or derivatives thereof. Up to the present, there has been no report that the decreased expression of the GIMAP6 gene and transcription product thereof could function as an esophageal cancer marker.

The 16th target nucleic acids are the FLJ11259 gene, homologs thereof, transcription products or cDNAs thereof, mutants thereof, or derivatives thereof. Up to the present, there has been no report that the decreased expression of the FLJ11259 gene and transcription product thereof could function as an esophageal cancer marker.

The 17th target nucleic acids are the C3AR1 gene, homologs thereof, transcription products or cDNAs thereof, mutants thereof, or derivatives thereof. Up to the present, there has been no report that the decreased expression of the C3AR1 gene and transcription product thereof could function as an esophageal cancer marker.

The 18th target nucleic acids are the PCGF2 gene, homologs thereof, transcription products or cDNAs thereof, mutants thereof, or derivatives thereof. Up to the present, there has been no report that the decreased expression of the PCGF2 gene or transcription product thereof could function as an esophageal cancer marker.

The 19th target nucleic acids are the PDE6D gene, homologs thereof, transcription products or cDNAs thereof, mutants thereof, or derivatives thereof. Up to the present, there has been no report that the decreased expression of the PDE6D gene or transcription product thereof could function as an esophageal cancer marker.

The 20th target nucleic acids are the PLCG2 gene, homologs thereof, transcription products or cDNAs thereof, mutants thereof, or derivatives thereof. Up to the present, there has been no report that the decreased expression of the PLCG2 gene or transcription product thereof could function as an esophageal cancer marker.

The 21st target nucleic acids are the GPR148 gene, homologs thereof, transcription products or cDNAs thereof, mutants thereof, or derivatives thereof. Up to the present, there has been no report that the decreased expression of the GPR148 gene or transcription product thereof could function as an esophageal cancer marker.

The 22nd target nucleic acids are the ARF6 gene, homologs thereof, transcription products or cDNAs thereof, mutants thereof, or derivatives thereof. Up to the present, there has been no report that the decreased expression of the ARF6 gene or transcription product thereof could function as an esophageal cancer marker.

The 23rd target nucleic acids are the NISCH gene, homologs thereof, transcription products or cDNAs thereof, mutants thereof, or derivatives thereof. Up to the present, there has been no report that the decreased expression of the NISCH gene or transcription product thereof could function as an esophageal cancer marker.

The 24th target nucleic acids are the GLYAT gene, homologs thereof, transcription products or cDNAs thereof, mutants thereof, or derivatives thereof. Up to the present, there has been no report that the decreased expression of the GLYAT gene or transcription product thereof could function as an esophageal cancer marker.

The 25th target nucleic acids are the IGHM gene, homologs thereof, transcription products or cDNAs thereof, mutants thereof, or derivatives thereof. Up to the present, there has been no report that the decreased expression of the IGHM gene or transcription product thereof could function as an esophageal cancer marker.

The 26th target nucleic acids are the FBOX38 gene, homologs thereof, transcription products or cDNAs thereof, mutants thereof, or derivatives thereof. Up to the present, there has been no report that the decreased expression of the FBOX38 gene or transcription product thereof could function as an esophageal cancer marker.

The 27th target nucleic acids are the SLC12A1 gene, homologs thereof, transcription products or cDNAs thereof, mutants thereof, or derivatives thereof. Up to the present, there has been no report that the decreased expression of the SLC12A1 gene or transcription product thereof could function as an esophageal cancer marker.

The 28th target nucleic acids are the PGDS gene, homologs thereof, transcription products or cDNAs thereof, mutants thereof, or derivatives thereof. Up to the present, there has been no report that the decreased expression of the PGDS gene or transcription product thereof could function as an esophageal cancer marker.

The 29th target nucleic acids are the CD48 gene, homologs thereof, transcription products or cDNAs thereof, mutants thereof, or derivatives thereof. Up to the present, there has been no report that the decreased expression of the CD48 gene or transcription product thereof could function as an esophageal cancer marker.

The 30th target nucleic acids are the IMPA2 gene, homologs thereof, transcription products or cDNAs thereof, mutants thereof, or derivatives thereof. Up to the present, there has been no report that the decreased expression of the IMPA2 gene or transcription product thereof could function as an esophageal cancer marker.

The 31st target nucleic acids are the HSPA6 gene, homologs thereof, transcription products or cDNAs thereof, mutants thereof, or derivatives thereof. Up to the present, there has been no report that the decreased expression of the HSPA6 gene or transcription product thereof could function as an esophageal cancer marker.

The 32nd target nucleic acids are the EIF3S9 gene, homologs thereof, transcription products or cDNAs thereof, mutants thereof, or derivatives thereof. Up to the present, there has been no report that the decreased expression of the EIF3S9 gene or transcription product thereof could function as an esophageal cancer marker.

The 33rd target nucleic acids are the ZNF659 gene, homologs thereof, transcription products or cDNAs thereof, mutants thereof, or derivatives thereof. Up to the present, there has been no report that the decreased expression of the ZNF659 gene or transcription product thereof could function as an esophageal cancer marker.

The 34th target nucleic acids are the RAB6C gene, homologs thereof, transcription products or cDNAs thereof, mutants thereof, or derivatives thereof. Up to the present, there has been no report that the decreased expression of the RAB6C gene or transcription product thereof could function as an esophageal cancer marker.

The 35th target nucleic acids are the NOL1 gene, homologs thereof, transcription products or cDNAs thereof, mutants thereof, or derivatives thereof. Up to the present, there has been no report that the decreased expression of the NOL1 gene or transcription product thereof could function as an esophageal cancer marker.

The 36th target nucleic acids are the DAB2 gene, homologs thereof, transcription products or cDNAs thereof, mutants thereof, or derivatives thereof. Up to the present, there has been no report that the decreased expression of the DAB2 gene or transcription product thereof could function as an esophageal cancer marker.

The 37th target nucleic acids are the EBI3 gene, homologs thereof, transcription products or cDNAs thereof, mutants thereof, or derivatives thereof. Up to the present, there has been no report that the decreased expression of the EBI3 gene or transcription product thereof could function as an esophageal cancer marker.

The 38th target nucleic acids are the PRSS3 gene, homologs thereof, transcription products or cDNAs thereof, mutants thereof, or derivatives thereof. Up to the present, there has been no report that the decreased expression of the PRSS3 gene or transcription product thereof could function as an esophageal cancer marker.

The 39th target nucleic acids are the GLB1 gene, homologs thereof, transcription products or cDNAs thereof, mutants thereof, or derivatives thereof. Up to the present, there has been no report that the decreased expression of the GLB1 gene or transcription products thereof could function as an esophageal cancer marker.

The 40th target nucleic acids are the SAMSN1 gene, homologs thereof, transcription products or cDNAs thereof, mutants thereof, or derivatives thereof. Up to the present, there has been no report that the decreased expression of the SAMSN1 gene or transcription product thereof could function as an esophageal cancer marker.

The 41st target nucleic acids are the APQ3 gene, homologs thereof, transcription products or cDNAs thereof, mutants thereof or derivatives thereof. Up to the present, there has been no report that the decreased expression of the APQ3 gene or transcription product thereof could function as an esophageal cancer marker.

The 42nd target nucleic acids are the CAPZA2 gene, homologs thereof, transcription products or cDNAs thereof, mutants thereof or derivatives thereof. Up to the present, there has been no report that the decreased expression of the CAPZA2 gene or transcription product thereof could function as an esophageal cancer marker.

The 43rd target nucleic acids are the B4GALT2 gene, homologs thereof, transcription products or cDNAs thereof mutants thereof, or derivatives thereof. Up to the present, there has been no report that the decreased expression of the B4GALT2 gene or transcription product thereof could function as an esophageal cancer marker.

The 44th target nucleic acids are the ARHGEF3 gene, homologs thereof, transcription products or cDNAs thereof, mutants thereof, or derivatives thereof. Up to the present, there has been no report that the decreased expression of the ARHGEF3 gene or transcription product thereof could function as an esophageal cancer marker.

The 45th target nucleic acids are the POGK gene, homologs thereof, transcription products or cDNAs thereof, mutants thereof, or derivatives thereof. Up to the present, there has been no report that the decreased expression of the POGK2 gene or transcription product thereof could function as an esophageal cancer marker.

The 46th target nucleic acids are the PRAF1 gene, homologs thereof, transcription products or cDNAs thereof, mutants thereof, or derivatives thereof. Up to the present, there has been no report that the decreased expression of the PRAF1 gene or transcription product thereof could function as an esophageal cancer marker.

The 47th target nucleic acids are the HPGD gene, homologs thereof, transcription products or cDNAs thereof mutants thereof, or derivatives thereof. The elevated expression of the HPGD gene in the metastatic substrain of the established esophageal cancer cell line is demonstrated in Kawamata, H. et al., 2003, Cancer Science, vol. 94, pp. 699-706.

1.2 Esophageal Cancer-Associated Target Nucleic Acids (2)

The other examples of the target nucleic acids as the esophageal cancer-associated markers for detecting, determining, or predicting the presence of esophageal cancer or esophageal cancer cells using the composition, kit, or DNA chip of the present invention include human genes comprising the nucleotide sequences as shown in SEQ ID NOS: 142 to 161 (i.e., GALNS, fgf3, CAMK2B, CaMKIINalpha, PSARL, XRCC3, CAPG, GRHPR, TROAP, RRM2, SATB2, C14orf162, SEPT6, M6PR, SPRR3, EML1, YPEL5, EIF4EBP2, SLC2A14, and SLIT2), homologs thereof, transcription products or cDNAs thereof, mutants thereof, and derivatives thereof. The terms "gene," "homolog," "transcription product," "cDNA," "mutant," and "derivative" are as defined above. Examples of preferable target nucleic acids are human genes each comprising a nucleotide sequence as shown in any of SEQ ID NOS: 142 to 161, transcription products thereof, or cDNAs thereof, more preferably transcription products or cDNAs thereof.

According to the present invention, the expression levels of the aforementioned target genes of esophageal cancer are significantly lowered in the esophageal cancer tissue when compared with non-cancerous tissues.

The 1st target nucleic acids are the GALNS gene, homologs thereof, transcription products or cDNAs thereof, mutants thereof, or derivatives thereof.

The GALNS gene is the N-acetylgalactosamine-6-sulfate sulfatase gene (Tomatsu, S. et al., 1991, Biochemical Biophysical Research Communication, vol. 181, pp. 677-683). The transcription product of this gene is known to be associated with metabolism of glycosaminoglycan, keratan sulfate, or chondroitin 6-sulfate in the lysosome, and the defect, deletion, or mutation of this gene is known to cause the Morquio A syndrome, which is inherited mucopolysaccharidosis (e.g., Fukuda, S. et al., 1992, Journal of Clinical Investigation, vol. 90, pp. 1049-1053). Primary symptoms of Morquio A syndrome are corneal clouding, aortic incompetence, urinary excretion of keratan sulfate, and osseous lesion. Up to the present, however, there has been no report that the decreased expression of the GALNS gene or transcription product thereof could function as an esophageal cancer marker.

The 2nd target nucleic acids are the fgf3 gene, homologs thereof, transcription products or cDNAs thereof, mutants thereof, or derivatives thereof.

The fgf3 gene belongs to the fibroblast growth factor family (Brookes, S. et al., 1989, Oncogene, vol. 4, pp. 429-436). It is suggested that the translation product of the gene contributes to ear formation, and it has been found that the gene is amplified as a proto-oncogene in a wide variety of human and murine cancer tissues including human esophageal cancer cells (Kitagawa, Y. et al., 1991, Cancer Research, vol. 51, pp. 1504-1508). Up to the present, however, there has been no report that the decreased expression of the fgf3 gene or transcription product thereof could function as an esophageal cancer marker.

The 3rd target nucleic acids are the CAMK2B gene, homologs thereof, transcription products or cDNAs thereof, mutants thereof, or derivatives thereof.

The CAMK2B gene is a gene for calcium/calmodulin-dependent protein kinases IIβ (Tombes, R. M. et al., 1997, Biochimica et Biophysica Acta, vol. 1355, pp. 281-292). It is suggested that the translation product thereof phosphorylates serine/threonine residues of a variety of substrates, and contributes to the regulation of cell cycles or the formation of the central nerve system. It is suggested that the activation of CAMK2B in small cell lung cancer cells accelerates the cell cycles (Williams, C. L. et al., 1996, Biochemical Pharmacology, vol. 51, pp. 707-715). Up to the present, however, there has been no report that the decreased expression of the cMAK2B gene or transcription product thereof could function as an esophageal cancer marker.

The 4th target nucleic acids are the CaMKIINalpha gene, homologs thereof, transcription products or cDNAs thereof, mutants thereof, or derivatives thereof.

The CAMKIINalpha gene is a gene for calcium/calmodulin-dependent protein kinases II (Strausberg, R. L. et al., 2002, Proceedings of the National Academic Sciences, U.S.A., vol. 99, pp. 16899-16903). It is known that LOC287005 is an inhibitory protein of calcium/calmodulin-dependent protein kinase II that has a high homology with the CaM-kinase II inhibitor alpha (rat LOC287005) and is specific to the brain (Chang B. H. et al., 2001, Neuroscience, vol. 102, pp. 767-777). Up to the present, however, there has been no report that the decreased expression of the CaMKIINalpha gene or transcription product thereof could function as an esophageal cancer marker.

The 5th target nucleic acids are the PSARL gene, homologs thereof, transcription products or cDNAs thereof, mutants thereof, or derivatives thereof.

The PSARL gene is a gene for presenilin-associated rhomboid-like protein (Pellegrini, L. et al., 2001, Journal of Alzheimer's Disease, vol. 3, pp. 181-190). It is known that the translation product of Rbd1, which is a PSARL homolog from *S. cerevisiae*, is present in the mitochondrial inner membrane and causes respiratory failure in defect thereof (MacQuibban, G et al., 2003, Nature, vol. 423, pp. 537-541). Up to the present, however, there has been no report that the decreased expression of the PSARL gene or transcription product thereof could function as an esophageal cancer marker.

The 6th target nucleic acids are the XRCC3 gene, homologs thereof, transcription products or cDNAs thereof, mutants thereof, or derivatives thereof.

The XRCC3 gene is a gene for X-ray repair complementing defective repair in Chinese hamster cells 3 (Tebbes, R. S. et al., 1995, Proceedings of the National Academic Sciences, U.S.A., vol. 92, pp. 6354-6358). It has been reported that the translation product of the XRCC3 gene is involved in repair of genetic disorder, and that significantly high mutation of the XRCC3 gene occurs in breast cancer (Kuschel, B. et al., 2002, Human molecular genetics, vol. 11, pp. 1399-1407) and in melanoma (Winsey, L. et al., 2000, Cancer Research, vol. 60, pp. 5612-5616). Up to the present, however, there has been no report that the decreased expression of the XRCC3 gene or transcription product thereof could function as an esophageal cancer marker.

The 7th target nucleic acids are the CAPG gene, homologs thereof, transcription products or cDNAs thereof, mutants thereof, or derivatives thereof.

The CAPG gene is a gene for actin capping protein of the gelsolin/bilin family (Dabiri, G A. et al., 1992, Journal of Biological Chemistry, vol. 267, pp. 16545-16552). The translation product of the gene binds to the sagittal ends of actin fibers but the translation product is assumed to be incapable of cleaving actin fibers. It is suggested that the translation product which was first found in macrophage may be involved in the function of macrophage. Up to the present, however, there has been no report that the decreased expression of the CAPG gene or transcription product thereof could function as an esophageal cancer marker.

The 8th target nucleic acids are the GRHPR gene, homologs thereof, transcription products or cDNAs thereof, mutants thereof, or derivatives thereof.

The GRHPR gene is a gene for glyoxylate reductase-hydroxypyruvate reductase (Rumsby, G et al., 1999, Biochimica et Biophysica Acta, vol. 1446, pp. 383-388). The translation product of the gene metabolizes glyoxylate into glycolate and irreversibly degrades hydroxypyruvate into D-glycerate. It is also suggested that this gene is a causative gene for primary hyperoxaluria type 2 (Cramer, S. D. et al., 1999, Human Molecular Genetics, vol. 8, pp. 2063-2069). Up to the present, however, there has been no report that the decreased expression of the GRHPR gene or transcription product thereof could function as an esophageal cancer marker.

The 9th target nucleic acids are the TROAP gene, homologs thereof, transcription products or cDNAs thereof, mutants thereof, or derivatives thereof.

The TROAP gene is a gene for trophinin-associated protein (TASTIN) (Fukuda, M. N. et al., 1995, Genes and Development, vol. 9, pp. 1199-1210). It is suggested that the translation product of the gene functions in conjunction with trophinin and it contributes to cell adhesion at the time of the implantation of an embryo into an endometrial cell (Fukuda, M. et al., ditto). Up to the present, however, there has been no report that the decreased expression of the TROAP gene or transcription product thereof could function as an esophageal cancer marker.

The 10th target nucleic acids are the RRM2 gene, homologs thereof, transcription products or cDNAs thereof, mutants thereof, or derivatives thereof.

The RRM2 gene is a gene for ribonucleotide-diphosphate reductase M2 chain (Yang-Feng, T. L. et al., 1987, Genomics, vol. 1, pp. 77-86). The translation product of the gene is a subunit of the enzyme that produces deoxyribonucleotides from ribonucleotides, which is a rate-determining enzyme in DNA synthesis. It has been demonstrated that the expression of the gene is elevated in invasive breast cancer or the like (e.g., Jensen, R. A. et al., 1994, Proceedings of the National Academy of Sciences, USA, vol. 91, pp. 9527-9261), and it is also known that the translation product is a target molecule in relation to the anticancer effect of hydroxyurea (Yen, Y. et al., 1994, Cancer Research, vol. 54, pp. 3686-3691). It is further known that the expression level of the gene increases upon expression of the resistance of a cancer cell line to the anticancer agent "gemcitabine" (e.g., Goan, Y. G. et al., 1999, Cancer Research, vol. 59, pp. 4204-4207). Up to the present, however, there has been no report that the decreased expression of the RRM2 gene or transcription product thereof could function as an esophageal cancer marker.

The 11th target nucleic acids are the SATB2 gene, homologs thereof, transcription products or cDNAs thereof, mutants thereof, or derivatives thereof.

The SATB2 gene is a gene for DNA sequence-binding protein (Kikuno, R. et al., 1999, DNA Research, vol. 6, pp. 197-205). It is known that the translation product of the gene binds to the nuclear matrix attachment regions of an immunoglobulin gene, thereby regulating the expression of the immunoglobulin gene, in pre-B cells (Dobreva, G, 2003, Genes & Development, vol. 17, pp. 3048-3061). Up to the present, however, there has been no report that the decreased expression of the SATB2 gene or transcription product thereof could function as an esophageal cancer marker.

The 12th target nucleic acids are the C14orf162 gene, homologs thereof, transcription products or cDNAs thereof, mutants thereof, or derivatives thereof.

The C14orf162 gene is a gene for chromoseme 14 open reading frame 162 (Mao, Y. et al., 2000, GenBank Direct submission). The function of the C14orf162 gene is not yet known. Up to the present, there has been no report that the decreased expression of the C14orf162 gene or transcription product thereof could function as an esophageal cancer marker.

The 13th target nucleic acids are the SEPT6 genes, homologs thereof, transcription products or cDNAs thereof, mutants thereof, or derivatives thereof.

The SEPT6 gene belongs to the septin family (Ono, R. et al., 2002, Cancer Research, vol. 62, pp. 333-337). The translation product of the gene comprises an ATP-GTP binding site and a sequence which is likely to be involved in transition into nucleus. The presence of several types of mutants thereof is also known. It is further known that the septin 6 gene is fused with MLL gene by translocation on chromosome in a patient with acute myelocytic leukemia (Ono, R. et al., supra). Up to the present, however, there has been no report that the decreased expression of the septin 6 gene or transcription product thereof could function as an esophageal cancer marker.

The 14th target nucleic acids are the M6PR gene, homologs thereof, transcription products or cDNAs thereof, mutants thereof, or derivatives thereof.

The M6PR gene is a gene for small mannose 6-phosphate receptor (Pohlmann, R. et al., 1987, Proceedings of the National Academic Sciences, U.S.A., vol. 84, pp. 5575-5579). It is demonstrated that the translation product of the gene functions as an IGF-II receptor, and that inhibiting the expression of the gene in chorionic cancer cells results in the inhibition of an ability to grow the cells (O'Gorman, D. B. et al., 1999, Cancer Research, vol. 59, pp. 5692-5694). Up to the present, however, there has been no report that the decreased expression of the M6PR gene or transcription product thereof could function as an esophageal cancer marker.

The 15th target nucleic acids are the SPRR3 gene, homologs thereof, transcription products or cDNAs thereof, mutants thereof, or derivatives thereof.

As mentioned above, the SPRR3 gene is known to be a marker of the esophageal cancer (WO 2003/042661, Chen, B. S. et al., 2000, Carcinogenesis, vol. 21, pp. 2147-2150, Abraham, J. M. et al., 1996, Cell Growth & Differentiation, vol. 7, pp. 855-860).

The 16th target nucleic acids are the EML1 gene, homologs thereof, transcription products or cDNAs thereof, mutants thereof, or derivatives thereof.

The EML1 gene is a gene for Echinoderm microtubule-associated protein-like 1 (Eudy, J. D. et al., 1997, Genomics, vol. 43, pp. 104-106). The sequence of EML1 gene comprises sequences that are suspected to be a calcium-binding motif and an active region of histidine acid phosphatase. Up to the present, however, there has been no report that the decreased expression of the EML1 gene or transcription product thereof could function as an esophageal cancer marker.

The 17th target nucleic acids are the YPEL5 gene, homologs thereof, transcription products or cDNAs thereof, mutants thereof, or derivatives thereof.

The YPEL5 gene is a gene for yippee-like 5 (*Drosophila*) (Roxstrom-Lindquist, K. et al., 2001, Insect molecular biology, vol. 10, pp. 77-86). The translation product of the YPEL5 gene belongs to the zinc-binding protein family. Up to the present, however, there has been no report that the decreased expression of the YPEL5 gene or transcription product thereof could function as an esophageal cancer marker.

The 18th target nucleic acids are the EIF4EBP2 gene, homologs thereof, transcription products or cDNAs thereof, mutants thereof, or derivatives thereof.

The EIF4EBP2 gene is a gene for eukaryotic translation initiation factor 4E-binding protein 2 (Pause, A. et al., 1994, Nature, vol. 371, pp. 762-767). The translation product of the EIF4EBP2 gene is a protein that regulates the initiation of gene expression, and the mutation of the gene is found in several types of cancers (Tsukiyama-Kohara, K. et al., 1996, Genomics, vol. 38, pp. 353-363). Up to the present, however, there has been no report that the decreased expression of the EIF4EBP2 gene or transcription product thereof could function as an esophageal cancer marker.

The 19th target nucleic acids are the SLC2A14 gene, homologs thereof, transcription products or cDNAs thereof, mutants thereof, or derivatives thereof.

The SLC2A14 gene is a gene for solute carrier family 2 (facilitated glucose transporter), member 14 (Strausberg, R. L. et al., 2002, Proceedings of the National Academic Sciences, U.S.A., vol. 99, pp. 16899-16903). The translation product of the SLC2A14 gene is a glucose transporter that is expressed specifically in the testise (Wu, X. et al., supra). Up to the present, however, there has been no report that the decreased expression of the SLC2A14 gene or transcription product thereof could function as an esophageal cancer marker.

The 20th target nucleic acids are the SLIT2 gene, homologs thereof, transcription products or cDNAs thereof, mutants thereof, or derivatives thereof.

The SLIT2 gene is a gene for SLIT, *Drosophila* homolog of 2 (Itoh, A. et al., 1998, Molecular Brain Research, vol. 62, pp. 175-186). It is known that the translation product of the gene is a secretory protein, and that it inhibits elongation of nerve fibers or migration of leukocytes (Wu, W. et al., 1999, Nature, vol. 400, pp. 331-336). Up to the present, however, there has been no report that the decreased expression of the SLIT2 gene or transcription product thereof could function as an esophageal cancer marker.

1.3 Esophageal Cancer-Associated Target Polypeptide (1)

Examples of target polypeptides as markers associated with the metastasis of esophageal cancer for detecting, determining, or predicting the presence or metastasis of esophageal cancer using the composition or kit of the present invention are polypeptides encoded by the aforementioned human genes comprising the nucleotide sequences as shown in SEQ ID NOS: 1 to 47; i.e., the genes being AXL, C6orf54, ZBTB11, TNFRSF14, NSUN5, SPEN, LTBP3, SYNGR1, ARL3, SLC13A1, RALGDS, ADD3, MAP3K12, AVPI1, GIMAP6, FLJ11259, C3AR1, PCGF2, PDE6D, PLCG2, GPR148, ARF6, NISCH, GLYAT, IGHM, FBXO38, SLC12A1, PGDS, CD48, IMPA2, HSPA6, EIF3S9, ZNF659, RAB6C, NOL1, DAB2, EBI3, PRSS3, GLB1, SAMSN1, AQP3, CAPZA2, B4GALT2, ARHGEF3, POGK, PRAF1 genes, and HPGD, respectively, for example, human polypeptides each comprising an amino acid sequence as shown in any of SEQ ID NOS: 95 to 141, homologs thereof, mutants thereof, and derivatives thereof. The terms "polypeptide," "homolog," "mutant," and "derivative" are as defined above. Preferred target polypeptides are human polypeptides comprising the amino acid sequence as shown in SEQ ID NOS: 95 to 141.

According to the present invention, the expression levels of said polypeptides, which are targets for the metastasis of esophageal cancer, significantly change (i.e., increase or decrease) in the esophageal cancer tissue from the patients with esophageal cancer in which the metastasis to lymph node was observed at surgery, when compared with the tissues from the patients with esophageal cancer in which the metastasis to lymph node was not observed at surgery, as in the case of the expression levels of the corresponding genes and of the translation products thereof. Alternatively, the blood levels of said polypeptides significantly change (i.e., increase or decrease) in the patients with esophageal cancer in which the metastasis to lymph node was observed at surgery, when compared with the patients with esophageal cancer in which the metastasis to lymph node was not observed at surgery.

1.4 Target Polypeptide of Esophageal Cancer (2)

Examples of target polypeptides as the esophageal cancer-associated markers for detecting, determining, or predicting the presence of esophageal cancer or esophageal cancer cells using the composition or kit of the present invention are polypeptides encoded by the GALNS, fgf3, CAMK2B, CaMKIINalpha, PSARL, XRCC3, CAPG, GRHPR, TROAP, RRM2, SATB2, C14orf162, SEPT6, M6PR, SPRR3, EML1, YPEL5, EIF4EBP2, SLC2A1, and SLIT2 genes, such as human polypeptides comprising the amino acid sequences as shown in SEQ ID NOS: 182 to 201, homologs thereof, mutants thereof, or derivatives thereof. The terms "polypeptide," "homolog," "mutant," and "derivative" are as defined above. Preferred target polypeptides are human polypeptides comprising the amino acid sequence as shown in SEQ ID NOS: 182 to 201.

The present invention is characterized in that the expression levels of said polypeptides, which are targets of esophageal cancer, significantly decrease in the esophageal cancer tissue, when compared with the non-cancerous tissue, as in the case of the expression levels of the corresponding genes and of the translation products thereof, or alternatively, that the blood levels of the polypeptides are significantly decreased in a subject with esophageal cancer, when compared with a healthy person.

1.5 Esophageal Cancer-Associated Target Polypeptide (3)

Other esophageal cancer markers for detecting esophageal cancer in vitro using the composition or kit of the present invention are polypeptides comprising the amino acid sequences as shown in SEQ ID NOS: 202 to 233, mutants thereof, or fragments thereof.

Polypeptides as shown in SEQ ID NOS: 202 to 233 of the invention are shown in Table 1 with the gene names, protein numbers (GenBank names and accession numbers), and properties. The listed polypeptides are detected specifically in, for example, blood plasma of patients with esophageal cancer, whereas they are not detected or are much lower than the detectable level in blood plasmas of healthy persons.

TABLE 1

| SEQ ID NO. | Gene name | Protein No. | Property |
|---|---|---|---|
| 202 | SMARCA1 | P28370 | SWI-SNF related matrix |
| 203 | ITGA1 | P56199 | Integrin subunit alpha 1 |
| 204 | GM632 | Q96KM6 | Protein containing five C2H2 type zinc finger domains |
| 205 | RREB1 | Q92766 | Ras responsive element binding protein |
| 206 | DHX37 | Q8IY37 | Member of the helicase |
| 207 | IGLC2 | P01842 | Igλ chain C region |
| 208 | TBC1D8 | O95759 | Vascular Rab-GAP-TBC-containing protein |
| 209 | ATP8B2 | P98198 | Protein with high similarity to aminophospholipid ATPase trasnporter |
| 210 | PYGL | P06737 | Liver glycogen phosphorylase |
| 211 | CDKL5 | O76039 | Cyclin-dependent kinase like 5 |
| 212 | SNX2 | O60749 | Sorting nexin 2 |
| 213 | TTC7A | Q9ULT0 | Protein containing seven tetratricopeptide repeats |
| 214 | ADSL | P30566 | Adenylsuccinate lyase |
| 215 | USP19 | O94966 | Member of the ubiquitin carboxyl-terminal hydrolase family |
| 216 | ABCC4 | O15439 | ATP-binding cassette subfamily C (CFTR/MRP) member 4 |
| 217 | GNPAT | O15228 | Dihydroxyacetone-phosphate-acyltransferase |
| 218 | MYBPC2 | Q14324 | Protein with high similarity to human MYBPC3 |
| 219 | BMP2K | Q9NSY1 | Protein with strong similarity to bmp 2-inducible kinase (mouse Bmp2k) |
| 220 | OXCT1 | P55809 | 3-oxoacid CoA transferase 1 |
| 221 | ITGA9 | Q13797 | Integrin alpha 9 subunit |
| 222 | SPATA7 | Q9P0W8 | Protein, unknown function |
| 223 | ZNF624 | Q9P2J8 | Member of the KRAB box family |
| 224 | USP20 | Q9Y2K6 | Ubiquitin specific protease 20 |
| 225 | ACAD8 | Q9UKU7 | Acyl-Coenzyme A dehydrogenase family member 8 |
| 226 | APLP2 | Q06481 | Amyloid beta precursor like protein 2 |
| 227 | HNRPR | O43390 | Heterogeneous nuclear ribonucleoprotein R |
| 228 | CD59 | P13987 | CD59 antigen (protectin) |
| 229 | DDX18 | Q9NVP1 | DEAD box protein 18 |
| 230 | SEC63 | Q9UGP8 | SEC63 protein |
| 231 | TMEM16C | Q9BYT9 | Member of the DUF590 protein, unknown function |
| 232 | TEKT2 | Q9UIF3 | Tektin 2 |
| 233 | BUB1 | O43683 | Budding uninhibited benzimidazoles 1 homolog |

According to the present invention, the levels of the target polypeptides for detecting esophageal cancer in a biological sample such as blood are significantly or remarkably high in a subject with esophageal cancer, when compared with healthy persons.

2. Probes for Diagnosing Esophageal Cancer

According to the present invention, the probes for detecting, determining, or predicting the presence and/or metastasis of esophageal cancer or for predicting the subject's prognosis after surgery are selected from the probes of group I, group II, and/or group III:

group I: polynucleotides consisting of:

(a) a polynucleotide consisting of a nucleotide sequence as shown in any of SEQ ID NOS: 1 to 46, a mutant thereof, or a fragment thereof comprising at least 15 continuous nucleotides, (b) a polynucleotide comprising a nucleotide sequence as shown in any of SEQ ID NOS: 1 to 46, (c) a polynucleotide consisting of a nucleotide sequence complementary to a nucleotide sequence as shown in any of SEQ ID NOS: 1 to 46, a mutant thereof, or a fragment thereof comprising at least 15 continuous nucleotides, (d) a polynucleotide comprising a nucleotide sequence complementary to a nucleotide sequence as shown in any of SEQ ID NOS: 1 to 46, and (e) a polynucleotide hybridizing under stringent conditions to any of the polynucleotides (a) to (d), or a fragment thereof comprising at least 15 continuous nucleotides;

group II: polynucleotides consisting of:

(f) a polynucleotide consisting of a nucleotide sequence as shown in any of SEQ ID NOS: 142 to 155 and 157 to 161, a mutant thereof, or a fragment thereof comprising at least 15 continuous nucleotides, (g) a polynucleotide comprising a nucleotide sequence as shown in any of SEQ ID NOS: 142 to 155 and 157 to 161, (h) a polynucleotide consisting of a nucleotide sequence complementary to a nucleotide sequence as shown in any of SEQ ID NOS: 142 to 155 and 157 to 161, a mutant thereof, or a fragment thereof comprising at least 15 continuous nucleotides, (i) a polynucleotide comprising a nucleotide sequence complementary to a nucleotide sequence as shown in any of SEQ ID NOS: 142 to 155 and 157 to 161, and (j) a polynucleotide hybridizing under stringent conditions to any of polynucleotides (f) to (i), or a fragment thereof comprising at least 15 continuous nucleotides; and group III: antibodies consisting of:

(k) an antibody specifically binding to at least one of polypeptides encoded by nucleotide sequences as shown in SEQ ID NOS: 1 to 46 or polypeptides having amino acid sequences as shown in SEQ ID NOS: 95 to 140, mutants thereof, and fragments thereof, or a fragment of the antibody, or a chemically modified derivative of the antibody or fragment, (l) an antibody specifically binding to at least one of polypeptides encoded by nucleotide sequences as shown in SEQ ID NOS: 142 to 155 and 157 to 161 or polypeptides having amino acid sequences as shown in SEQ ID NOS: 182 to 195 and 197 to 201, mutants thereof, and fragments thereof, or a fragment of the antibody, or a chemically modified derivative of the antibody or fragment, and (m) an antibody specifically binding to at least one of polypeptides having amino acid sequences as shown in SEQ ID NOS: 202 to 232, mutants thereof, and fragments thereof, or a fragment of the antibody, or a chemically modified derivative of the antibody or fragment thereof.

All of the above-described probes can bind to any of the esophageal cancer-associated markers described in Sections 1.1 to 1.5 above, and they can be used for detecting, determining, or predicting the presence or metastasis of esophageal cancer. For example, any probe of group I and group III (k) enables detection, determination, or prediction of the presence or metastasis of esophageal cancer. Also, any probe of group II and group II (l) and (m) enables detection, determination, or prediction of the presence of esophageal cancer.

According to the present invention, the nucleic acid probe includes DNA or RNA, and the antibody probe includes, for example, a polyclonal antibody, a monoclonal antibody, a fragment thereof, a synthetic antibody, a recombinant antibody, a polyspecific antibody, or a single-chain antibody.

We have now found that the probes as described in groups I to III could be used for detecting, determining, or predicting the presence and/or metastasis of esophageal cancer for the first time.

3. Composition for Diagnosing Esophageal Cancer 3.1 Nucleic Acid Composition (1)

According to the present invention, the nucleic acid composition for detecting, determining, or predicting the presence and/or metastasis of esophageal cancer comprises one or two or more probes of group I as described in Section 2 above. The composition enables a qualitative and/or quantitative measurement of the presence, expression levels, or existing amounts of the target nucleic acids associated with the metastasis of esophageal cancer, i.e., the human-derived AXL, C6orf54, ZBTB11, TNFRSF14, NSUN5, SPEN, LTBP3, SYNGR1, ARL3, SLC13A1, RALGDS, ADD3, MAP3K12, AVPI1, GIMAP6, FLJ11259, C3AR1, PCGF2, PDE6D, PLCG2, GPR148, ARF6, NISCH, GLYAT, IGHM, FBXO38, SLC12A1, PGDS, CD48, IMPA2, HSPA6, EIF3S9, ZNF659, RAB6C, NOL1, DAB2, EBI3, PRSS3, GLB1, SAMSN1, AQP3, CAPZA2, B4GALT2, ARHGEF3, POGK, PRAF1 and HPGD genes, homologs thereof, transcription products or cDNAs thereof, mutants thereof, or derivatives thereof.

The expression levels of said target nucleic acids significantly change (i.e., increase or decrease) in the esophageal cancer tissue from the patient in which the metastasis to lymph node was observed at surgery, when compared with the esophageal cancer tissue from the patient in which the metastasis to lymph node was not observed at surgery. Accordingly, the composition of the present invention can be effectively used for measuring and comparing the expression levels of the target nucleic acids both in the esophageal cancer tissue of the patient in which the metastasis to lymph node was observed at surgery and in the esophageal cancer tissue of the patient in which the metastasis to lymph node was not observed at surgery.

The compositions usable in the present invention include a combination of one or more polynucleotides selected from: polynucleotides comprising the nucleotide sequences as shown in SEQ ID NOS: 1 to 47 as observed in the body tissue of a patient with esophageal cancer, and polynucleotides complementary thereto; polynucleotides hybridizing under stringent conditions to DNA consisting of nucleotide sequences complementary to said nucleotide sequences, and polynucleotides complementary thereto; and polynucleotides comprising at least 15 continuous nucleotides in the nucleotide sequences of said polynucleotides.

Specifically, the composition of the present invention can comprise one or more polynucleotides or fragments thereof set forth below:

(1) polynucleotides each consisting of a nucleotide sequence as shown in any of SEQ ID NOS: 1 to 46 and 47, mutants thereof, or fragments thereof comprising at least 15 continuous nucleotides;

(2) polynucleotides each comprising a nucleotide sequence as shown in any of SEQ ID NOS: 1 to 46 and 47;

(3) polynucleotides each consisting of a nucleotide sequence as shown in any of SEQ ID NOS: 1 to 46, mutants thereof, or fragments thereof comprising at least 15 continuous nucleotides;

(4) polynucleotides each comprising a nucleotide sequence as shown in any of SEQ ID NOS: 1 to 46;

(5) polynucleotides each consisting of a nucleotide sequence complementary to a nucleotide sequence as shown in any of SEQ ID NOS: 1 to 46, mutants thereof, or fragments thereof comprising at least 15 continuous nucleotides;

(6) polynucleotides each comprising a nucleotide sequence complementary to a nucleotide sequence as shown in any of SEQ ID NOS: 1 to 46;

(7) polynucleotides each hybridizing under stringent conditions to DNA consisting of a nucleotide sequence complementary to a nucleotide sequence as shown in any of SEQ ID NOS: 1 to 46, or fragments thereof comprising at least 15 continuous nucleotides;

(8) polynucleotides each hybridizing under stringent conditions to DNA consisting of a nucleotide sequence as shown in any of SEQ ID NOS: 1 to 46 or fragments thereof comprising at least 15 continuous nucleotides;

(9) a polynucleotide consisting of the nucleotide sequence as shown in SEQ ID NO: 47, a mutant thereof, or a fragment thereof comprising at least 15 continuous nucleotides;

(10) a polynucleotide comprising the nucleotide sequence as shown in SEQ ID NO: 47;

(11) a polynucleotide consisting of a nucleotide sequence complementary to the nucleotide sequence as shown in SEQ ID NO: 47, a mutant thereof, or a fragment thereof comprising at least 15 continuous nucleotides;

(12) polynucleotides comprising a nucleotide sequence complementary to the nucleotide sequence as shown in SEQ ID NO: 47;

(13) a polynucleotide hybridizing under stringent conditions to DNA consisting of a nucleotide sequence complementary to the nucleotide sequence as shown in SEQ ID NO: 47 or a fragment thereof comprising at least 15 continuous nucleotides; and

(14) a polynucleotide hybridizing under stringent conditions to DNA consisting of the nucleotide sequence as shown in SEQ ID NO: 47 or a fragment thereof comprising at least 15 continuous nucleotides.

Fragments of the polynucleotide as described in (1) to (14) above can include, but are not limited to, nucleotide sequences of, for example, continuous 15 to all nucleotides, 15 to 5,000 nucleotides, 15 to 4,500 nucleotides, 15 to 4,000 nucleotides, 15 to 3,500 nucleotides, 15 to 3,000 nucleotides, 15 to 2,500 nucleotides, 15 to 2,000 nucleotides, 15 to 1,500 nucleotides, 15 to 1,000 nucleotides, 15 to 900 nucleotides, 15 to 800 nucleotides, 15 to 700 nucleotides, 15 to 600 nucleotides, 15 to 500 nucleotides, 15 to 400 nucleotides, 15 to 300 nucleotides, 15 to 250 nucleotides, 15 to 200 nucleotides, 15 to 150 nucleotides, 15 to 140 nucleotides, 15 to 130 nucleotides, 15 to 120 nucleotides, 15 to 110 nucleotides, 15 to 100 nucleotides, 15 to 90 nucleotides, 15 to 80 nucleotides, 15 to 70 nucleotides, 15 to 60 nucleotides, 15 to 50 nucleotides, 15 to 40 nucleotides, 15 to 30 nucleotides, or 15 to 25 nucleotides; 25 to all nucleotides, 25 to 1,000 nucleotides, 25 to 900 nucleotides, 25 to 800 nucleotides, 25 to 700 nucleotides, 25 to 600 nucleotides, 25 to 500 nucleotides, 25 to 400 nucleotides, 25 to 300 nucleotides, 25 to 250 nucleotides, 25 to 200 nucleotides, 25 to 150 nucleotides, 25 to 140 nucleotides, 25 to 130 nucleotides, 25 to 120 nucleotides, 25 to 110 nucleotides, 25 to 100 nucleotides, 25 to 90 nucleotides, 25 to 80 nucleotides, 25 to 70 nucleotides, 25 to 60 nucleotides, 25 to 50 nucleotides, or 25 to 40 nucleotides; 50 to all nucleotides, 50 to 1,000 nucleotides, 50 to 900 nucleotides, 50 to 800 nucleotides, 50 to 700 nucleotides, 50 to 600 nucleotides, 50 to 500 nucleotides, 50 to 400 nucleotides, 50 to 300 nucleotides, 50 to 250 nucleotides, 50 to 200 nucleotides, 50 to 150 nucleotides, 50 to 140 nucleotides, 50 to 130 nucleotides, 50 to 120 nucleotides, 50 to 110 nucleotides, 50 to 100 nucleotides, 50 to 90 nucleotides, 50 to 80 nucleotides, 50 to 70 nucleotides, or 50 to 60 nucleotides; or 60 to all nucleotides, 60 to 1,000 nucleotides, 60 to 900 nucleotides, 60 to 800 nucleotides, 60 to 700 nucleotides, 60 to 600 nucleotides, 60 to 500 nucleotides, 60 to 400 nucleotides, 60 to 300 nucleotides, 60 to 250 nucleotides, 60 to 200 nucleotides, 60 to 150 nucleotides, 60 to 140 nucleotides, 60 to 130 nucleotides, 60 to 120 nucleotides, 60 to 110 nucleotides, 60 to 100 nucleotides, 60 to 90 nucleotides, 60 to 80 nucleotides, and 60 to 70 nucleotides, in the nucleotide sequence of each polynucleotide.

According to an embodiment of the invention, fragments of polynucleotides comprising the nucleotide sequences as shown in SEQ ID NOS: 1 to 47 preferably comprise a nucleotide sequence as shown in any of SEQ ID NOS: 48 to 94, a complementary sequence thereof, or a partial sequence comprising at least 15 continuous nucleotides thereof.

The composition of the present invention includes the following polynucleotide or polynucleotides, for example.

(1) a polynucleotide comprising at least 15 continuous nucleotides in each of the nucleotide sequences as shown in SEQ ID NOS: 1 to 46 or complementary sequences thereof;

(2) a polynucleotide comprising at least 60 continuous nucleotides of in each of the nucleotide sequences as shown in SEQ ID NOS: 1 to 46 or complementary sequences thereof;

(3) a polynucleotide comprising at least 15 continuous nucleotides in the nucleotide sequence as shown in SEQ ID NO: 47 or a complementary sequence thereof;

(4) a polynucleotide comprising at least 60 continuous nucleotides in the nucleotide sequence as shown in SEQ ID NO: 47 or a complementary sequence thereof;

(5) a polynucleotide comprising a nucleotide sequence as shown in any of SEQ ID NOS: 48 to 93 in the nucleotide sequence as shown in SEQ ID NOS: 1 to 46, and comprising at least 60 continuous nucleotides;

(6) a polynucleotide comprising a sequence complementary to a nucleotide sequence as shown in any of SEQ ID NOS: 48 to 93 in the sequences complementary to the nucleotide sequences as shown in SEQ ID NOS: 1 to 46, and comprising at least 60 continuous nucleotides;

(7) a polynucleotide comprising the nucleotide sequence as shown in SEQ ID NO: 94 in the nucleotide sequence as shown in SEQ ID NO: 47, and comprising at least 60 continuous nucleotides; and (8) a polynucleotide comprising a sequence complementary to the nucleotide sequence as shown in SEQ ID NO: 94 in the sequence complementary to the nucleotide sequence as shown in SEQ ID NO: 47, and comprising at least 60 continuous nucleotides.

The polynucleotides or fragments thereof as used in the invention may be DNA or RNA.

Polynucleotides in the compositions of the present invention can be prepared by common techniques such as recombinant DNA technology, PCR, or a method of using an automatic DNA/RNA synthesizer.

Recombinant DNA technology or PCR can include the use of the techniques as disclosed in, for example, Ausubel. et al., Current Protocols in Molecular Biology, John Wiley & Sons, US (1993); or Sambrook et al., Molecular Cloning: A Laboratory Manual, Cold Spring Harbor Laboratory Press, US (1989).

The human-derived AXL, C6orf54, ZBTB11, TNFRSF14, NSUN5, SPEN, LTBP3, SYNGR1, ARL3, SLC13A1, RALGDS, ADD3, MAP3K12, AVPI1, GIMAP6, FLJ11259, C3AR1, PCGF2, PDE6D, PLCG2, GPR148, ARF6, NISCH, GLYAT, IGHM, FBXO38, SLC12A1, PGDS, CD48, IMPA2, HSPA6, EIF3S9, ZNF659, RAB6C, NOL1, DAB2, EBI3, PRSS3, GLB1, SAMSN1, AQP3, CAPZA2, B4GALT2, ARHGEF3, POGK, PRAF1, and HPGD genes are known, and the methods for obtaining the same are also known as described above. Thus, these genes can be cloned in order to prepare polynucleotides as the compositions of the present invention.

Polynucleotides constituting the compositions of the present invention may be chemically synthesized using an automatic DNA synthesizer. Such synthesis is generally carried out by the phosphoramidite method, which enables the automatic synthesis of a single-stranded DNA of at most about 100 nucleotides. The automatic DNA synthesizer is commercially available from, for example, Polygen, ABI, or Applied BioSystems.

Also, the polynucleotides of the present invention can be prepared via cDNA cloning. Total RNA is extracted from a tissue of a living body, such as esophageal tissue, in which the target gene or genes of the present invention is/are expressed, the extracted total RNA is applied to the oligo dT cellulose column to obtain poly A(+) RNA, cDNA library is prepared therefrom via RT-PCR, and the target cDNA clones can be obtained from the resulting library via a screening method such as hybridization screening, expression screening, or antibody screening. If necessary, the cDNA clones may be amplified by PCR. Probes or primers can be selected and synthesized from any sequences comprising 15 to 100 continuous nucleotides in the nucleotide sequences as shown in SEQ ID NOS: 1 to 47. The cDNA cloning technique is described in, for example, Sambrook, J. & Russel, D., Molecular Cloning, A LABORATORY MANUAL, Cold Spring Harbor Laboratory Press, Jan. 15, 2001, vol. 1: 7.42 to 7.45, vol. 2: 8.9 to 8.17, and the techniques disclosed therein can be employed for preparing the polynucleotides used in the invention.

3.2 Nucleic Acid Composition (2)

According to the present invention, other examples of the nucleic acid compositions for detecting, determining, or predicting the presence of esophageal cancer or esophageal cancer cells comprise one or more probes of group II as described in Section 2 above, which probes enable a qualitative and/or quantitative measurement of the presence, expression levels, or existing amounts of the esophageal cancer-associated target nucleic acids, i.e., human-derived GALNS, fgf3, CAMK2B, CaMKIINalpha, PSARL, XRCC3, CAPG, GRHPR, TROAP, RRM2, SATB2, C14orf162, SEPT6, M6PR, SPRR3, EML1, YPEL5, EIF4EBP2, SLC2A14, and SLIT2 genes, homologs thereof, transcription products or cDNAs thereof, mutants thereof, or derivatives thereof.

The expression levels of said target nucleic acids are significantly lowered in the esophageal cancer tissue as compared with non-cancerous tissue. Thus, the composition of the present invention can be effectively used for measuring and comparing the expression levels of the target nucleic acids both in non-cancerous tissue and in esophageal cancer tissue.

The compositions usable in the present invention include a combination of one or more polynucleotides selected from the group consisting of: polynucleotides each comprising a nucleotide sequence as shown in any of SEQ ID NOS: 142 to 161 observed in the body tissue of a patient with esophageal cancer, and polynucleotides complementary thereto; polynucleotides each hybridizing under stringent conditions to DNA consisting of a nucleotide sequence complementary to said nucleotide sequence, and polynucleotides complementary thereto; and polynucleotides comprising at least 15 continuous nucleotides in the nucleotide sequences of the polynucleotides.

Specifically, the composition of the present invention may comprise one or more polynucleotides or fragments thereof as set forth below:

(1) polynucleotides consisting of the respective nucleotide sequences as shown in SEQ ID NOS: 142 to 161, mutants thereof, or fragments thereof comprising at least 15 continuous nucleotides;

(2) polynucleotides comprising the respective nucleotide sequences as shown in SEQ ID NOS: 142 to 161;

(3) polynucleotides consisting of the nucleotide sequences as shown in SEQ ID NOS: 142 to 155, mutants thereof, or fragments thereof comprising at least 15 continuous nucleotides;

(4) polynucleotides comprising the respective nucleotide sequences as shown in SEQ ID NOS: 142 to 155;

(5) polynucleotides consisting of nucleotide sequences complementary to the respective nucleotide sequences as shown in SEQ ID NOs: 142 to 155, mutants thereof, or fragments thereof comprising at least 15 continuous nucleotides;

(6) polynucleotides comprising nucleotide sequences complementary to the respective nucleotide sequences as shown in SEQ ID NOS: 142 to 155;

(7) polynucleotides hybridizing under stringent conditions to DNA consisting of nucleotide sequences complementary to the respective nucleotide sequences as shown in SEQ ID NOS: 142 to 155 or fragments thereof comprising at least 15 continuous nucleotides;

(8) polynucleotides hybridizing under stringent conditions to DNA consisting of the respective nucleotide sequences as shown in SEQ ID NOS: 142 to 155 or fragments thereof comprising at least 15 continuous nucleotides;

(9) polynucleotides consisting of the respective nucleotide sequences as shown in SEQ ID NOS: 157 to 161, mutants thereof, or fragments thereof comprising at least 15 continuous nucleotides;

(10) polynucleotides comprising the respective nucleotide sequences as shown in SEQ ID NOS: 157 to 161;

(11) polynucleotides consisting of nucleotide sequences complementary to the respective nucleotide sequences as shown in SEQ ID NOs: 157 to 161, mutants thereof, or fragments thereof comprising at least 15 continuous nucleotides;

(12) polynucleotides comprising nucleotide sequences complementary to the respective nucleotide sequences as shown in SEQ ID NOS: 157 to 161;

(13) polynucleotides hybridizing under stringent conditions to DNA consisting of nucleotide sequences complementary to the respective nucleotide sequences as shown in SEQ ID NOS: 157 to 161 or fragments thereof comprising at least 15 continuous nucleotides;

(14) polynucleotides hybridizing under stringent conditions to DNA consisting of the respective nucleotide sequences as shown in SEQ ID NOS: 157 to 161 or fragments thereof comprising at least 15 continuous nucleotides;

(15) a polynucleotide consisting of the nucleotide sequence as shown in SEQ ID NO: 156, a mutant thereof, or a fragment thereof comprising at least 15 continuous nucleotides;

(16) a polynucleotide comprising the nucleotide sequence as shown in the SEQ ID NO: 156;

(17) a polynucleotide consisting of a nucleotide sequence complementary to the nucleotide sequence as shown in SEQ ID NO: 156, a mutant thereof, or fragments thereof comprising at least 15 continuous nucleotides;

(18) a polynucleotide comprising a nucleotide sequence complementary to the nucleotide sequence as shown in SEQ ID NO: 156;

(19) a polynucleotide hybridizing under stringent conditions to DNA consisting of a nucleotide sequence complementary to the nucleotide sequence as shown in SEQ ID NO: 156, or fragments thereof comprising at least 15 continuous nucleotides; and

(20) a polynucleotide hybridizing under stringent conditions to DNA consisting of the nucleotide sequence as shown in SEQ ID NO: 156, or fragments thereof comprising at least 15 continuous nucleotides.

Fragments of the polynucleotides as described in (1) to (14) above may comprise, but are not limited to, nucleotide sequences of, for example, continuous 15 to all nucleotides, 15 to 5,000 nucleotides, 15 to 4,500 nucleotides, 15 to 4,000 nucleotides, 15 to 3,500 nucleotides, 15 to 3,000 nucleotides, 15 to 2,500 nucleotides, 15 to 2,000 nucleotides, 15 to 1,500 nucleotides, 15 to 1,000 nucleotides, 15 to 900 nucleotides, 15 to 800 nucleotides, 15 to 700 nucleotides, 15 to 600 nucleotides, 15 to 500 nucleotides, 15 to 400 nucleotides, 15 to 300 nucleotides, 15 to 250 nucleotides, 15 to 200 nucleotides, 15 to 150 nucleotides, 15 to 140 nucleotides, 15 to 130 nucleotides, 15 to 120 nucleotides, 15 to 110 nucleotides, 15 to 100 nucleotides, 15 to 90 nucleotides, 15 to 80 nucleotides, 15 to 70 nucleotides, 15 to 60 nucleotides, 15 to 50 nucleotides, 15 to 40 nucleotides, 15 to 30 nucleotides, or 15 to 25 nucleotides; 25 to all nucleotides, 25 to 1,000 nucleotides, 25 to 900 nucleotides, 25 to 800 nucleotides, 25 to 700 nucleotides, 25 to 600 nucleotides, 25 to 500 nucleotides, 25 to 400 nucleotides, 25 to 300 nucleotides, 25 to 250 nucleotides, 25 to 200 nucleotides, 25 to 150 nucleotides, 25 to 140 nucleotides, 25 to 130 nucleotides, 25 to 120 nucleotides, 25 to 110 nucleotides, 25 to 100 nucleotides, 25 to 90 nucleotides, 25 to 80 nucleotides, 25 to 70 nucleotides, 25 to 60 nucleotides, 25 to 50 nucleotides, or 25 to 40 nucleotides; 50 to all nucleotides, 50 to 1000 nucleotides, 50 to 900 nucleotides, 50 to 800 nucleotides, 50 to 700 nucleotides, 50 to 600 nucleotides, 50 to 500 nucleotides, 50 to 400 nucleotides, 50 to 300 nucleotides, 50 to 250 nucleotides, 50 to 200 nucleotides, 50 to 150 nucleotides, 50 to 140 nucleotides, 50 to 130 nucleotides, 50 to 120 nucleotides, 50 to 110 nucleotides, 50 to 100 nucleotides, 50 to 90 nucleotides, 50 to 80 nucleotides, 50 to 70 nucleotides, or 50 to 60 nucleotides; or 60 to all nucleotides, 60 to 1000 nucleotides, 60 to 900 nucleotides, 60 to 800 nucleotides, 60 to 700 nucleotides, 60 to 600 nucleotides, 60 to 500 nucleotides, 60 to 400 nucleotides, 60 to 300 nucleotides, 60 to 250 nucleotides, 60 to 200 nucleotides, 60 to 150 nucleotides, 60 to 140 nucleotides, 60 to 130 nucleotides, 60 to 120 nucleotides, 60 to 110 nucleotides, 60 to 100 nucleotides, 60 to 90 nucleotides, 60 to 80 nucleotides, or 60 to 70 nucleotides, in the nucleotide sequence of each polynucleotide.

According to one embodiment, preferably fragments of polynucleotides comprising the nucleotide sequences as shown in SEQ ID NOS: 142 to 161 comprise the nucleotide sequences as shown in SEQ ID NOS: 162 to 181, respectively, complementary sequences thereof, or partial sequences thereof comprising at least 15 continuous nucleotides.

The composition of the present invention includes the following polynucleotides, for example.

(1) a polynucleotide comprising at least 15 continuous nucleotides in each of the nucleotide sequences as shown in SEQ ID NOS: 142 to 155 or complementary sequences thereof;

(2) a polynucleotide comprising at least 60 continuous nucleotides in each of the nucleotide sequences as shown in SEQ ID NOS: 142 to 155 or complementary sequences thereof;

(3) a polynucleotide comprising at least 15 continuous nucleotides in each of the nucleotide sequences as shown in SEQ ID NOS: 151 to 161 or complementary sequences thereof;

(4) a polynucleotide comprising at least 60 continuous nucleotides in each of the nucleotide sequences as shown in SEQ ID NOS: 151 to 161 or complementary sequences thereof;

(5) a polynucleotide comprising a nucleotide sequence as shown in any of SEQ ID NOS: 162 to 175 and comprising at least 60 continuous nucleotides in the nucleotide sequence as shown in any of SEQ ID NOS: 142 to 155, respectively;

(6) a polynucleotide comprising a sequence complementary to a nucleotide sequence as shown in any of SEQ ID NOS: 162 to 175 and comprising at least 60 continuous nucleotides in the nucleotide sequence complementary to the nucleotide sequence as shown in any of SEQ ID NOS: 142 to 155, respectively;

(7) a polynucleotide comprising a nucleotide sequence as shown in any of SEQ ID NOS: 177 to 181 and comprising at least 60 continuous nucleotides in the nucleotide sequence as shown in any of SEQ ID NOS: 157 to 161, respectively;

(8) a polynucleotide comprising a sequence complementary to a nucleotide sequence as shown in any of SEQ ID NOS: 177 to 181 in polynucleotides comprising at least 60 continuous nucleotides in the nucleotide sequence complementary to the nucleotide sequence as shown in any of SEQ ID NOS: 157 to 161, respectively;

(9) a polynucleotide comprising at least 15 continuous nucleotides of the nucleotide sequence as shown in SEQ ID NO: 156 or a complementary sequence thereof;

(10) a polynucleotide comprising at least 60 continuous nucleotides of the nucleotide sequence as shown in SEQ ID NO: 156 or a complementary sequence thereof;

(11) a polynucleotide comprising the nucleotide sequence as shown in SEQ ID NO: 176 and comprising at least 60 continuous nucleotides in the nucleotide sequence as shown in SEQ ID NO: 156; and

(12) a polynucleotide comprising a nucleotide sequence complementary to the nucleotide sequence as shown in SEQ ID NO: 176 and comprising at least 60 continuous nucleotides in the sequence complementary to the nucleotide sequence as shown in SEQ ID NO: 156.

The polynucleotides or fragments thereof that are used in the present invention may be DNA or RNA.

Polynucleotides in the compositions of the present invention can be prepared by the common techniques such as recombinant DNA technology, PCR, or a method of using an automatic DNA/RNA synthesizer.

Recombinant DNA technology or PCR can include the use of the techniques disclosed in, for example, Ausubel et al., Current Protocols in Molecular Biology, John Wiley & Sons, US (1993); or Sambrook et al., Molecular Cloning A Laboratory Manual, Cold Spring Harbor Laboratory Press, US (1989).

The GALNS, fgf3, CAMK2B, CaMKIINalpha, PSARL, XRCC3, CAPG, GRHPR, TROAP, RRM2, SATB2, C14orf162, SEPT6, M6PR, SPRR3, EML1, YPEL5, EIF4EBP2, SLC2A14, and SLIT2 genes are known, and the methods for obtaining the same are also known. Thus, such genes can be cloned in order to prepare polynucleotides as the compositions of the present invention.

The GALNS gene can be obtained by the method described in, for example, Tomatsu, S. et al., 1991, Biochemical Biophysical Research Communication, vol. 181, pp. 677-683.

The fgf3 gene can be obtained by the method described in, for example, Brookes, S. et al., 1989, Oncogene, vol. 4, pp. 429-436.

The CMK2B gene can be obtained by the method described in, for example, Tombes, R. M. et al., 1997, Biochimica et Biophysica Acta, vol. 1355, pp. 281-292.

The CAMKIINalpha gene can be obtained by the method described in, for example, Strausberg, R. L. et al., 2002, Proceedings of the National Academic Sciences, U.S.A., vol. 99, pp. 16899-16903.

The PSARL gene can be obtained by the method described in, for example, Pellegrini, L. et al., 2001, Journal of Alzheimer's Disease, vol. 3, pp. 181-190.

The XRCC3 gene can be obtained by the method described in, for example, Tebbes, R. S. et al., 1995, Proceedings of the National Academic Sciences, U.S.A., vol. 92, pp. 6354-6358.

The CAPG gene can be obtained by the method described in, for example, Dabiri, G. A. et al., 1992, Journal of Biological Chemistry, vol. 267, pp. 16545-16552.

The GRHPR gene can be obtained by the method described in, for example, Rumsby, G. et al., 1999, Biochimica et Biophysica Acta, vol. 1446, pp. 383-388.

The TROAP gene can be obtained by the method described in, for example, Fukuda, M. N. et al., 1995, Genes and Development, vol. 9, pp. 1199-1210.

The RRM2 gene can be obtained by the method described in, for example, Yang-Feng, T. L. et al., 1987, Genomics, vol. 1, pp. 77-86.

The SATB2 gene can be obtained by the method described in, for example, Kikuno, R. et al., 1999, DNA Research, vol. 6, pp. 197-205

Cloning of C14orf162 gene was reported in, for example, Mao, Y et al., 2000.

The SEPT6 gene can be obtained by the method described in, for example, Ono, R. et al., 2002, Cancer Research, vol. 62, pp. 333-337.

The M6PR gene can be obtained by the method described in, for example, Pohlmann, R. et al., 1987, Proceedings of the National Academic Sciences, U.S.A., vol. 84, pp. 5575-5579.

The SPRR3 gene can be obtained by the method described in, for example, Gibbs, S. et al., 1993, Genomics, vol. 16, pp. 630-637.

The EML1 gene can be obtained by the method described in, for example, Eudy, J. D. et al., 1997, Genomics, vol. 43, pp. 104-106.

The YPEL5 gene can be obtained by the method described in, for example, Roxstrom-Lindquist, K. et al., 2001, Insect molecular biology, vol. 10, pp. 77-86.

The EIF4EBP2 gene can be obtained by the method described in, for example, Pause, A. et al., 1994, Nature, vol. 371, pp. 762-767.

The SLC2A14 gene can be obtained by the method described in, for example, Strausberg, R. L. et. al., 2002, Proceedings of the National Academic Sciences, U.S.A., vol. 99, pp. 16899-16903.

The SLIT2 gene can be obtained by the method described in, for example, Itoh, A. et al., 1998, Molecular Brain Research, vol. 62, pp. 175-186.

Polynucleotides constituting the compositions of the present invention can be chemically synthesized using an automatic DNA synthesizer. Such synthesis is generally carried out by the phosphoramidite method, which enables the automatic synthesis of a single-stranded DNA of at most about 100 nucleotides. The DNA automatic synthesizer is commercially available from, for example, Polygen, ABI, or Applied BioSystems.

Alternatively, the polynucleotides of the present invention can be prepared via cDNA cloning. Total RNA is extracted from the body tissue such as the esophageal tissue in which the target gene of the present invention is expressed, the extracted total RNA is applied to the oligo dT cellulose column to obtain poly A(+) RNA, cDNA library is prepared therefrom via RT-PCR, and the target cDNA clones can be obtained from the resulting library via hybridization screening, expression screening, or antibody screening. The cDNA clones can be amplified by PCR according to need. Probes or primers can be selected and synthesized from sequences comprising 15 to 100 continuous nucleotides of a nucleotide sequence as shown in any of SEQ ID NOs: 142 to 161. The cDNA cloning technique is described in, for example, Sambrook, J. & Russel, D., Molecular Cloning, A LABORATORY MANUAL, Cold Spring Harbor Laboratory Press, Jan. 15, 2001, vol. 1: 7.42 to 7.45, vol. 2: 8.9 to 8.17, and such technique can be employed for preparing polynucleotide.

3.3 Antibody Composition

The compositions of the present invention can comprise, as probes for diagnosing esophageal cancer, the antibodies of group III described in Section 2 above, fragments thereof, or chemically modified derivatives thereof. Such compositions are useful for detecting, determining, or predicting in vitro the presence and/or metastasis of esophageal cancer in a subject having esophageal cancer. Prediction of metastasis can lead to prediction of good or poor prognosis of the subject after surgery.

(A) The first example of the antibody composition of the present invention is a composition comprising: one or more antibodies against polypeptides having the amino acid sequences as shown in SEQ ID NOS: 95 to 140 of group III (k), mutants thereof, or fragments thereof, fragments thereof, or chemically modified derivatives thereof.

The composition of the present invention can further comprise an antibody against a polypeptide having the amino acid sequence as shown in SEQ ID NO: 141, a mutant thereof, or a fragment thereof, a fragment thereof, or a chemically modified derivative thereof. Use of such antibodies in combination can improve the accuracy for predicting prognosis.

Specifically, the present invention provides a composition for detecting, determining, or predicting the presence and/or metastasis of esophageal cancer, which composition comprises one or more antibodies against the markers for the metastasis of esophageal cancer, i.e., polypeptides encoded by the aforementioned AXL, C6orf54, ZBTB11, TNFRSF14, NSUN5, SPEN, LTBP3, SYNGR1, ARL3, SLC13A1, RALGDS, ADD3, MAP3K12, AVPI1, GIMAP6, FLJ11259, C3AR1, PCGF2, PDE6D, PLCG2, GPR148, ARF6, NISCH, GLYAT, IGHM, FBXO38, SLC12A1, PGDS, CD48, IMPA2, HSPA6, EIF3S9, ZNF659, RAB6C, NOL1, DAB2, EBI3, PRSS3, GLB1, SAMSN1, AQP3, CAPZA2, B4GALT2, ARHGEF3, POGK, PRAF1, and HPGD genes, homologs thereof, mutants thereof, derivatives thereof, or fragments thereof, in combination for detecting such polypeptides, homologs, mutants, derivatives, or fragments.

(B) The second example of the antibody composition of the present invention is a composition comprising: one or more antibodies against polypeptides having the amino acid sequence as shown in SEQ ID NOS: 182 to 195 and 197 to 201 of group III (1), mutants thereof, or fragments thereof, fragments thereof, or chemically modified derivatives thereof.

The composition of the present invention can further comprise an antibody against a polypeptide having the amino acid sequence as shown in SEQ ID NO: 196, a mutant thereof, or a fragment thereof, a fragment thereof, or a chemically modified derivative thereof.

Specifically, the present invention provides a composition for detecting, determining, or predicting the presence of esophageal cancer that comprises one or more antibodies against the esophageal cancer markers, i.e., polypeptides encoded by the GALNS, fgf3, CAMK2B, CaMKIINalpha, PSARL, XRCC3, CAPG, GRHPR, TROAP, RRM2, SATB2, C14orf162, SEPT6, M6PR, SPRR3, EML1, YPEL5, EIF4EBP2, SLC2A14, and SLIT2 genes, homologs thereof, mutants thereof, or derivatives thereof, in combination for detecting such polypeptides, homologs, mutants, or derivatives.

(C) The third example of the antibody composition of the present invention is a composition for detecting, determining, or predicting in vitro the presence of esophageal cancer of a subject having esophageal cancer that comprises: one or more antibodies against polypeptides having the amino acid sequences as shown in SEQ ID NOs: 202 to 232 of group III (m), mutants thereof, or fragments thereof, fragments thereof, or chemically modified derivatives thereof.

The composition of the present invention can further comprise: an antibody binding specifically to at least one of a polypeptide having the amino acid sequence as shown in SEQ ID NO: 233, a mutant thereof, and a fragment thereof, a fragment thereof, or a chemically modified derivative thereof.

Such polypeptides are encoded by the genes shown in Table 1.

The above-mentioned polypeptides can be obtained by the recombinant DNA technology. For example, the cDNA clones obtained in the above-described manner are incorporated into an expression vector, which is then transformed or transfected into procaryotic or eucaryotic host cells, and the resulting procaryotic or eucaryotic host cells are cultured. Thus, polypeptides of interest can be obtained from the cells or culture supernatants. Vectors and expression systems are commercially available from Novagen, Takara Shuzo (Japan), Daiichi Pure Chemicals (Japan), Qiagen, Stratagene, Promega, Roche Diagnostics, Invitrogen, Genetics Institute, or Amersham Bioscience.

Examples of host cells that can be used are procaryotic cells such as bacteria (e.g., *E. coli* or *Bacillus subtilis*), yeast (e.g., *Saccharomyces cerevisiae*), insect cells (e.g., Sf cells), and mammalian cells (e.g., COS, CHO, and BHK cells).

Vectors can comprise, in addition to DNA encoding each of the aforementioned polypeptides, regulatory elements such as promoter, enhancer, polyadenylation signal, ribosome-binding site, replication origin, terminator, and selection marker.

Moreover, in order to facilitate the purification of a polypeptide, a peptidic label may be added to the C- or N-terminus of the polypeptide to form a fusion polypeptide. Examples of representative peptidic labels include, but are not limited to, $(histidine)_{6-10}$ repeat, FLAG, myc peptide, and GFP polypeptide. The recombinant DNA techniques are described in Sambrook, J. & Russel, D. (supra).

When the polypeptides of the present invention are produced without the addition of a peptidic label, the polypeptides can be purified by, for example, ion-exchange chromatography. In addition to this, gel filtration, hydrophobic chromatography, isoelectric chromatography or the like may be carried out in combination. When the protein has a peptidic label, such as histidine repeat, FLAG, myc, or GFP, an affinity chromatography suitable for each peptidic label can be carried out in accordance with conventional techniques. Construction of such an expression vector that facilitates isolation or purification is preferable. When the expression vector is constructed so as to express in the form of the fusion polypeptide of a polypeptide with a peptidic label, which vector is used to prepare the polypeptide by genetic engineering techniques, the isolation or purification of the polypeptide is easy.

According to the present invention, the mutants of the above polypeptides are a mutant comprising a deletion, substitution, addition, or insertion of one or more amino acids, preferably one or several amino acids, in each of the amino acid sequences as shown in SEQ ID NOS: 95 to 141, 182 to 201, and 202 to 233 or partial sequences thereof, or alternatively a mutant having an identity of about 80% or higher, about 85% or higher, preferably about 90% or higher, more preferably about 95% or higher, about 97% or higher, about 98% or higher, or about 99% or higher with said amino acid sequence or a partial sequence thereof. Examples of such mutants include naturally-occurring mutants, such as a homolog of a mammalian species other than human, a mutant thereof based on human polymorphism or splicing mutation, or the like.

According to the present invention, a fragment of the polypeptide or mutant thereof consists of at least 5, at least 7, at least 10, at least 15, preferably at least 20, at least 25, more preferably at least 30, at least 40, or at least 50 continuous amino acid residues in the amino acid sequence of the polypeptide, and has a single epitope or a plurality of epitopes. Such a fragment can immunospecifically bind to the antibody of the present invention or a fragment thereof. The polypeptide may be cleaved or fragmented by an enzyme that is present in the body, such as protease or peptidase, thereby being present as fragments.

The thus-obtained antibody that recognizes the polypeptide can specifically bind to the polypeptide via an antigen-binding site of the antibody. Specifically, a polypeptide having an amino acid sequence as shown in any of SEQ ID NOS: 95 to 141, 182 to 201, and 202 to 233, a fragment thereof, a mutant thereof, or a fusion polypeptide can be used as an immunogen to produce immunoreactive antibodies.

More specifically, the polypeptide, a fragment thereof, a mutant thereof, or a fusion polypeptide comprises an antigenic determinant or epitope that elicits antibody formation, which antigen determinant or epitope may have a linear structure or a higher-order (or disconnected) structure. Such antigen determinant or epitope can be identified by any epitope analysis known in the art, such as phage display or reverse immunogenetics.

Antibodies of any aspect are elicited by the polypeptides of the present invention. If all, part, or an epitope of the polypeptide is isolated, a polyclonal or monoclonal antibody can be prepared in accordance with conventional techniques. An example of the method for preparing an antibody is described in Kennet et al. (ed.), Monoclonal Antibodies, Hybridomas: A New Dimension in Biological Analyses, Plenum Press, New York, 1980.

A polyclonal antibody can be preparing by immunizing an animal such as a bird (e.g., a chicken) or a mammalian (e.g., a rabbit, goat, horse, sheep, or mouse) with the polypeptide of the invention. The antibody of interest can be purified from the blood of an immunized animal via an appropriate combination of techniques such as ammonium sulfate fractionation, ion-exchange chromatography, and affinity chromatography.

A monoclonal antibody can be obtained by the technique comprising producing hybridoma cell lines that produce monoclonal antibodies specific for each relevant polypeptide in a mouse in accordance with conventional techniques. One method for producing such hybridoma cell lines comprises immunizing an animal with an enzyme polypeptide of the invention, removing spleen cells from the immunized animal, fusing the spleen cells with a myeloma cell line to produce hybridoma cells therefrom, and determining a hybridoma cell line that produces a monoclonal antibody binding to the enzyme of interest. A monoclonal antibody can be recovered by a conventional technique.

The antibody of the present invention is not particularly limited, provided that such antibody can bind specifically to the target polypeptide of the present invention or a fragment thereof. The antibody usable in the invention is a monoclonal or polyclonal antibody, preferably monoclonal antibody. Examples of other antibodies include a recombinant antibody, a synthetic enzyme, a polyspecific antibody (e.g., a bispecific antibody), a single-stranded antibody, and an antibody fragment. Specific examples of such antibodies include Fab, $F(ab')_2$, scFv, Fv, and dsFv. The globulin type and class of the antibody of the present invention are not particularly limited, as long as the antibody has the aforementioned properties, and may be any of IgG, IgM, IgA, IgE, IgD, $IgG_1$, $IgG_2$, $IgG_3$, $IgG_4$, $IgA_1$, and $IgA_2$.

Preparation of Monoclonal Antibody:

(1) Immunization and Collection of Antibody-Producing Cell

The immunogen which is a target polypeptide is administered to a mammalian animal such as rat, mouse (e.g., the inbred mouse strain Balb/c), or rabbit. The dose of the immunogen is appropriately determined depending on, for example, the type of an animal to be immunized or the route of administration, and it is about 50 to 200 μg per animal. Immunization is primarily performed by injecting an immunogen subcutaneously or intraperitoneally. The intervals of immunization are not particularly limited. After the primary immunization, boost immunization is carried out 2 to 10 times, preferably 3 or 4 times, at the intervals of several days to several weeks, and preferably at the intervals of 1 to 4 weeks. After the primary immunization, the antibody titer of the blood serum of the immunized animal is repeatedly measured by, for example, enzyme-linked immuno sorbent assay (ELISA). When the antibody titer reached a plateau, the immunogen is injected intravenously or intraperitoneally to complete the final immunization. The antibody-producing cells are recovered 2 to 5 days, preferably 3 days, after the final immunization. Examples of antibody-producing cells include spleen cells, lymph node cells, and peripheral blood cells, preferably spleen cells or regional lymph node cells.

(2) Cell Fusion

Hybridoma cell lines that produce monoclonal antibodies specific for target polypeptides are prepared. Such hybridomas can be produced and identified via conventional techniques. The method for producing such hybridoma cell lines comprises immunizing an animal with a protein of the invention, removing spleen cells from the immunized animal, fusing the spleen cells with a myeloma cell line, producing hybridoma cells therefrom, and determining a hybridoma cell line that produces a monoclonal antibody binding to the enzyme of interest. Myeloma cell lines to be fused with antibody-producing cells can be commercially available established cell lines of animals such as mice. Preferably, cell lines to be used have drug selectivity; namely, they cannot survive in the HAT selection medium (containing hypoxanthine, aminopterin, and thymine) in an unfused state, while they can survive only in a state fused with antibody-producing cells. The established cells are preferably derived from an animal of the same species with the animal to be immunized. An example of the myeloma cell line is the strain P3X63-Ag.8 (ATCC TIB9), which is a BALB/c mouse-derived hypoxanthine guanine phosphoribosyl•transferase (HGPRT) deficient cell line.

Subsequently, the myeloma cell lines are fused with the antibody-producing cells. Cell fusion is carried out in a serum-free medium for animal cell culture, such as DMEM or RPMI-1640 medium, by mixing the antibody-producing cells with the myeloma cell lines at about 1:1 to 20:1 in the presence of a cell fusion accelerator. As the cell fusion accelerator, polyethylene glycol having an average molecular weight of 1,500 to 4,000 daltons can be used at a concentration of about 10 to 80%, for example. Optionally, an auxiliary agent, such as dimethyl sulfoxide, can be used in combination in order to enhance the fusion efficiency. Further, the antibody-producing cells can be fused with the myeloma cell lines by using a commercially available cell fusion apparatus utilizing electric stimulus (e.g., electroporation).

(3) Selection and Cloning of Hybridomas

The hybridomas of interest are selected from the fused cells. To this end, the cell suspension is adequately diluted in, for example, a fetal bovine serum-containing RPMI-1640 medium, then the suspension is aliquoted into each well of a microtiter plate at about two million cells/well, to which wells are added a selection medium, and thereafter culture is carried out while appropriately exchanging the selection medium with the same fresh medium. The culture temperature is 20° C. to 40° C., preferably about 37° C. When the myeloma cell is an HGPRT-deficient strain or thymidine kinase-deficient strain, a hybridoma of a cell having an ability to produce an antibody and a myeloma cell line can selectively be cultured and grown in the selection medium containing hypoxanthine, aminopterin, and thymine (i.e., the HAT medium). As a result, cells grown about 14 days after the initiation of culture in the selection medium can be obtained as the hybridoma.

Subsequently, whether or not the culture supernatant of the grown hybridoma contains the antibody of interest is screened for. Screening of hybridomas can be carried out in accordance with conventional techniques, without particular limitation. For example, the culture supernatant in the well containing the grown hybridomas is partially sampled and then subjected to enzyme immuno assay (EIA) or ELISA or radio immuno assay (RIA). The fused cells are cloned using the limiting dilution method or the like, and monoclonal antibody-producing cells, i.e. hybridomas, are established in the end. The hybridoma of the present invention is stable during the culture in a basic medium, such as RPMI-1640 or DMEM, as described below, and the hybridoma can produce and secrete a monoclonal antibody that reacts specifically with a target polypeptide.

(4) Recovery of Antibody

Monoclonal antibody can be recovered by conventional techniques. Specifically, a monoclonal antibody can be collected from the established hybridoma by the conventional cell culture technique, the ascites development, or the like. According to the cell culture technique, hybridoma is cultured in an animal cell culture medium, such as 10% fetal bovine serum-containing RPMI-1640 medium, MEM medium, or a serum-free medium, under common culture conditions (e.g., 37° C., 5% $CO_2$) for 2 to 10 days, and the antibody is obtained from the culture supernatant. In the case of the ascites development, about 10 millions of myeloma-derived hybridomas cells are administered intraperitoneally to an animal of the same species as the mammal from which the myeloma cell is derived, so asr to allow the hybridoma cells to grow in a large quantity. After one to two weeks, the ascites or blood serum is collected from said animal.

Where the purification of an antibody is required in the above-described method for collecting the antibody, the conventional techniques, such as salting out by ammonium sulfate, ion-exchange chromatography, affinity chromatography, and gel chromatography, may be appropriately selected or combined to obtain the purified monoclonal antibody.

Preparation of Polyclonal Antibody:

When polyclonal antibodies are prepared, an animal like rabbit is immunized in the same manner as described above, the antibody titer is measured 6 to 60 days after the final immunization by enzyme immunoassay (EIA or ELISA) or radio immunoassay (RIA), and blood is taken on the day the maximal antibody titer is measured, in order to obtain antiserum. Thereafter, the reactivity of the polyclonal antibodies in the antiserum is assayed by ELISA or the like.

Chemically Modified Derivative:

The antibody of the present invention or a fragment thereof may be a chemically modified derivative. Examples include derivatives labeled with an enzyme, fluorophore, or radioisotope, and chemically modified derivatives, such as an acetylated, acylated, alkylated, phosphorylated, sulfated, or glycosylated derivatives.

Examples of the labels for used in enzyme immunoassay are enzymes such as peroxidase (POD), alkaline phosphatase, β-galactosidase, urease, catalase, glucose oxidase, lactate dehydrogenase, amylase, and biotin-avidin complexes. Examples of the labels for use in fluorescence immunoassay are fluorescent substances or fluorophores, such as fluorescein isothiocyanate, tetramethylrhodamine isothiocyanate, substituted rhodamine isothiocyanate, dichlorotriazine isothiocyanate, Alexa, and AlexaFluoro. Examples of the labels for use in radio immunoassay are radioactive isotopes, such as tritium, iodine ($^{131}I$, $^{125}I$, $^{123}I$, and $^{121}I$), phosphorus ($^{32}P$), sulfur ($^{35}S$), and metals (e.g., $^{68}Ga$, $^{67}Ga$, $^{68}Ge$, $^{54}Mn$, $^{99}Mo$, $^{99}Tc$, and $^{133}Xe$). Examples of the labels for use in luminescent immunoassay are luminescent molecules, luminescent substances, or bioluminescent substances, such as an NADH-, FMNH2-, luciferase system, luminol-hydrogen peroxide-POD system, acridinium ester system, or dioxetane compound system.

Alternatively, an avidin-biotin system or streptavidin-biotin system can also be used optionally. In such a case, biotin may be bound to the antibodies of the present invention or fragments thereof, for example. A label can be bound to an antibody by conventional techniques, such as the glutaraldehyde method, the maleimide method, the pyridyl disulfide method, or the periodic acid method in the case of enzyme immunoassay. In radioimmunoassay, the binding of label and antibody can be carried out in accordance with the conventional techniques, such as the chloramine-T method and Bolton-Hunter method.

4. Kit for Diagnosis of Esophageal Cancer 4.1 Nucleic Acid Kit

The present invention also provides a kit for detecting, determining, or predicting in vitro the presence or metastasis of esophageal cancer, comprising one or more polynucleotides of group I and group II described in Section 2 above, polynucleotides of Sections 3.1 and 3.2 above, mutants thereof, and/or fragments thereof.

The kit of the present invention can include nucleic acid probes of group I and of group II as described below. These probes can be packaged in suitable containers, alone or in combination.

Nucleic Acid Probes of Group I:

According to the present invention, nucleic acid probes of group I that are included in the kit of the present invention can be used for detecting, determining, or predicting the presence and/or metastasis of esophageal cancer.

The kit of the present invention can comprise at least one of polynucleotides comprising the nucleotide sequences as shown in SEQ ID NOS: 1 to 46, polynucleotides comprising complementary sequences thereof, polynucleotides hybridizing under stringent conditions to said polynucleotides, or fragments thereof.

The kit of the present invention can further comprise at least one of a polynucleotide comprising the nucleotide sequence as shown in SEQ ID NO: 47, a polynucleotide comprising a complementary sequence thereof, a polynucleotide hybridizing under stringent conditions to said polynucleotide, or a fragment thereof.

Fragments of the polynucleotides, which can be contained in the kit of the invention, are, for example, at least one DNA selected from the following groups (1) to (5):

(1) DNAs comprising at least 15 continuous nucleotides in the respective nucleotide sequences as shown in SEQ ID NOS: 1 to 46 or 47 or complementary sequences thereof;

(2) DNAs comprising at least 60 continuous nucleotides in the respective nucleotide sequences as shown in SEQ ID NOS: 1 to 46 or 47 or complementary sequences thereof;

(3) DNAs comprising the nucleotide sequences as shown in SEQ ID NOS: 48 to 93 and 94 or complementary sequences thereof and comprising at least 60 continuous nucleotides in the nucleotide sequences as shown in SEQ ID NOS: 1 to 46 and 47, respectively, or complementary sequences thereof;

(4) DNAs consisting of the respective nucleotide sequences as shown in SEQ ID NOS: 48 to 93 and 94; or (5) DNAs comprising nucleotide sequences complementary to the respective nucleotide sequences as shown in SEQ ID NOS: 48 to 93 and 94.

According to a preferable embodiment, the polynucleotide is a polynucleotide consisting of a nucleotide sequence as shown in any of SEQ ID NOS: 1 to 46, a polynucleotide consisting of a complementary sequence thereof, a polynucleotide hybridizing under stringent conditions to said polynucleotide, or a fragment comprising at least 15 continuous nucleotides thereof.

According to another preferable embodiment, the kit of the present invention can further comprise, in addition to the above polynucleotide, a polynucleotide consisting of the nucleotide sequence as shown SEQ ID NO: 47, a polynucleotide consisting of a complementary sequence thereof, a polynucleotide hybridizing under stringent conditions to said polynucleotide, or a fragment comprising at least 15 continuous nucleotides thereof.

According to a preferable embodiment, the fragment can be a polynucleotide comprising at least 15, preferably at least 60 continuous nucleotides.

According to another preferable embodiment, the fragment is a polynucleotide comprising a nucleotide sequence as shown in any of SEQ ID NOS: 48 to 93 and 94 and comprising at least 60 continuous nucleotides in the nucleotide sequence as shown in any of SEQ ID NOS: 1 to 46 and 47, respectively, or a polynucleotide comprising a nucleotide sequence complementary thereto.

According to another preferable embodiment, the fragment is a polynucleotide comprising a nucleotide sequence as shown in any of SEQ ID NOS: 48 to 93 and 94.

According to another preferable embodiment, the fragment is a polynucleotide comprising a nucleotide sequence complementary to a nucleotide sequence as shown in any of SEQ ID NOS: 48 to 93 and 94.

According to another preferable embodiment, the fragment is a polynucleotide consisting of a nucleotide sequence as shown in any of SEQ ID NOS: 48 to 93 and 94.

Specific examples of the aforementioned combinations include: a polynucleotide comprising the nucleotide sequence as shown in SEQ ID NO: 1 or 2 or a complementary sequence thereof, a polynucleotide hybridizing under stringent conditions to such polynucleotide, and/or a fragment thereof; a polynucleotide comprising a nucleotide sequence as shown in any of SEQ ID NOS: 1 to 3 or a complementary sequence thereof, a polynucleotide hybridizing under stringent conditions to such polynucleotide, and/or a fragment thereof; a polynucleotide comprising a nucleotide sequence as shown in any of SEQ ID NOS: 1 to 4 or a complementary sequence thereof, a polynucleotide hybridizing under stringent conditions to such polynucleotide, and/or a fragment thereof; a polynucleotide comprising a nucleotide sequence as shown in any of SEQ ID NOS: 1 to 5 or a complementary sequence thereof, a polynucleotide hybridizing under stringent conditions to such polynucleotide, and/or a fragment thereof; a polynucleotide comprising a nucleotide sequence as shown in any of SEQ ID NOS: 1 to 6 or a complementary sequence thereof, a polynucleotide hybridizing under stringent conditions to such polynucleotide, and/or a fragment thereof; a polynucleotide comprising a nucleotide sequence as shown in any of SEQ ID NOS: 1 to 7 or a complementary sequence thereof, a polynucleotide hybridizing under stringent conditions to such polynucleotide, and/or a fragment thereof; a polynucleotide comprising a nucleotide sequence as shown in any of SEQ ID NOS: 1 to 8 or a complementary sequence thereof, a polynucleotide hybridizing under stringent conditions to such polynucleotide, and/or a fragment thereof; a polynucleotide comprising a nucleotide sequence as shown in any of SEQ ID NOS: 1 to 9 or a complementary sequence thereof, a polynucleotide hybridizing under stringent conditions to such polynucleotide, and/or a fragment thereof; a polynucleotide comprising a nucleotide sequence as shown in any of SEQ ID NOS: 1 to 10 or a complementary sequence thereof, a polynucleotide hybridizing under stringent conditions to such polynucleotide, or a fragment thereof; a polynucleotide comprising a nucleotide sequence as shown in any of SEQ ID NOS: 1 to 11 or a complementary sequence thereof, a polynucleotide hybridizing under stringent conditions to such polynucleotide, and/or a fragment thereof; a polynucleotide comprising a nucleotide sequence as shown in any of SEQ ID NOS: 1 to 12 or a complementary sequence thereof, a polynucleotide hybridizing under stringent conditions to such polynucleotide, and/or a fragment thereof; a polynucleotide comprising a nucleotide sequence as shown in any of SEQ ID NOS: 1 to 13 or a complementary sequence thereof, a polynucleotide hybridizing under stringent conditions to such polynucleotide, and/or a fragment thereof; a polynucleotide comprising a nucleotide sequence as shown in any of SEQ ID NOS: 1 to 14 or a complementary sequence thereof, a polynucleotide hybridizing under stringent conditions to such polynucleotide, and/or a fragment thereof; a polynucleotide comprising a nucleotide sequence as shown in any of SEQ ID NOS: 1 to 15 or a complementary sequence thereof, a polynucleotide hybridizing under stringent conditions to such polynucleotide, and/or a fragment thereof; a polynucleotide comprising a nucleotide sequence as shown in any of SEQ ID NOS: 1 to 16 or a complementary sequence thereof, a polynucleotide hybridizing under stringent conditions to such polynucleotide, and/or a fragment thereof; a polynucleotide comprising a nucleotide sequence as shown in any of SEQ ID NOS: 1 to 17 or a complementary sequence thereof, and/or a fragment thereof; a polynucleotide comprising a nucleotide sequence as shown in any of SEQ ID NOS: 1 to 18 or a complementary sequence thereof, a polynucleotide hybridizing under stringent conditions to such polynucleotide, and/or a fragment thereof; a polynucleotide comprising a nucleotide sequence as shown in any of SEQ ID NOS: 1 to 19 or a complementary sequence thereof, a polynucleotide hybridizing under stringent conditions to such polynucleotide, and/or a fragment thereof; a polynucleotide comprising a nucleotide sequence as shown in any of SEQ ID NOS: 1 to 20 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 21 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 22 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 23 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 24 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 25 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 26 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 27 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 28 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 29 or a complementary sequence thereof, a polynucleotide hybridizing under stringent conditions to such polynucleotide, and/or a fragment thereof; a polynucleotide comprising a nucleotide sequence as shown in any of SEQ ID NOS: 1 to 30 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 31 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 32 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 33 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 34 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 35 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 36 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 37 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 38 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 39 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 40 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 41 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 42 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 43 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 44 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 45 or a complementary sequence thereof, a polynucleotide hybridizing under stringent conditions to such polynucleotide, and/or a fragment thereof, a polynucleotide comprising a nucleotide sequence as shown in any of SEQ ID NOS: 1 to 46 or a complementary sequence thereof, a polynucleotide hybridizing under stringent conditions to such polynucleotide, and/or a fragment thereof, and a polynucleotide comprising a nucleotide sequence as shown in any of SEQ ID NOS: 1 to 47 or a complementary sequence thereof, a polynucleotide hybridizing under stringent conditions to such polynucleotide, and/or a fragment thereof.

According to another more preferable embodiment, the kit of the present invention can comprise at least two to all polynucleotides of the polynucleotides comprising the nucleotide sequences as shown in SEQ ID NOS: 48 to 93 and 94 or complementary sequences thereof.

Nucleic Acid Probes of Group II:

According to the present invention, the nucleic acid probes of group II that are included in the kit of the present invention can be used for detecting, determining, or predicting the presence of esophageal cancer.

The kit of the present invention can comprise at least one of a polynucleotide comprising a nucleotide sequence as shown in any of SEQ ID NOS: 142 to 155 and 157 to 161, a polynucleotide comprising a complementary sequence thereof, a polynucleotide hybridizing under stringent conditions to such polynucleotide, or a fragment thereof.

The kit of the present invention can further include at least one of a polynucleotide comprising the nucleotide sequence as shown in SEQ ID NO: 156, a polynucleotide comprising a complementary sequence thereof, a polynucleotide hybridizing under stringent conditions to such polynucleotide, or a fragment thereof.

A polynucleotide fragment that can be included in the kit of the present invention is, for example, at least one DNA selected from the following groups (1) to (5):

(1) DNAs comprising at least 15 continuous nucleotides in the respective nucleotide sequences as shown in SEQ ID NOS: 142 to 161 or complementary sequences thereof;

(2) DNAs comprising at least 60 continuous nucleotides in the respective nucleotide sequences as shown in SEQ ID NOS: 142 to 161 or complementary sequences thereof;

(3) DNAs comprising the nucleotide sequences as shown in SEQ ID NOS: 162 to 181 or complementary sequences thereof and comprising at least 60 continuous nucleotides in the nucleotide sequences as shown in SEQ ID NOS: 142 to 161, respectively, or complementary sequences thereof;

(4) DNAs consisting of the respective nucleotide sequences as shown in SEQ ID NOS: 162 to 181; and (5) DNAs comprising nucleotide sequences complementary to the respective nucleotide sequences as shown in SEQ ID NOS: 162 to 181.

According to a preferable embodiment, the polynucleotide is a polynucleotide consisting of a nucleotide sequence as shown in any of SEQ ID NOS: 142 to 155 and 157 to 161, a polynucleotide consisting of a complementary sequence thereof, a polynucleotide hybridizing under stringent conditions to such polynucleotide, or a fragment thereof comprising at least 15 continuous nucleotides.

According to another preferable embodiment, the kit of the present invention can further comprise, in addition to the above polynucleotides, a polynucleotide consisting of the nucleotide sequence as shown in SEQ ID NO: 156, a polynucleotide consisting of a complementary sequence thereof, a polynucleotide hybridizing under stringent conditions to such polynucleotide, or a fragment thereof comprising at least 15 continuous nucleotides.

According to a preferable embodiment, the fragment can be a polynucleotide comprising at least 15, preferably at least 60 continuous nucleotides.

According to another preferable embodiment, the fragment is a polynucleotide comprising a nucleotide sequence as shown in any of SEQ ID NOS: 162 to 181 and comprising at least 60 continuous nucleotides in a nucleotide sequence as shown in any of SEQ ID NOS: 142 to 161, respectively, or a polynucleotide comprising a nucleotide sequence complementary thereto.

According to another preferable embodiment, the fragment is a polynucleotide comprising a nucleotide sequence as shown in any of SEQ ID NOS: 162 to 181.

According to another preferable embodiment, the fragment is a polynucleotide comprising a nucleotide sequence complementary to a nucleotide sequence as shown in any of SEQ ID NOS: 162 to 181.

According to the other preferable embodiment, the fragment is a polynucleotide consisting of a nucleotide sequence as shown in any of SEQ ID NOS: 162 to 181.

According to a preferable embodiment, the kit of the present invention includes one or more polynucleotides selected from a polynucleotide comprising a nucleotide sequence as shown in any of SEQ ID NOS: 142 to 155, a polynucleotide comprising a complementary sequence thereof, a polynucleotide hybridizing under stringent conditions to such polynucleotide, or a fragment thereof comprising at least 15 continuous nucleotides.

Examples of the polynucleotides include, but are not limited to, a polynucleotide comprising a nucleotide sequence as shown in any of SEQ ID NOS: 162 to 175 and comprising at least 60 continuous nucleotides in a nucleotide sequence as shown in any of SEQ ID NOS: 142 to 155, respectively, and a polynucleotide comprising a nucleotide sequence complementary thereto.

According to another preferable embodiment, the kit of the present invention includes one or more polynucleotides selected from a polynucleotide comprising a nucleotide sequence as shown in any of SEQ ID NOS: 157 to 161, a polynucleotide comprising a complementary sequence thereof, a polynucleotide hybridizing under stringent conditions to such polynucleotide, or a fragment thereof comprising at least 15 continuous nucleotides.

Examples of the polynucleotides include, but are not limited to, a polynucleotide comprising a nucleotide sequence as shown in any of SEQ ID NOS: 177 to 181 and comprising at least 60 continuous nucleotides in a nucleotide sequence as shown in any of SEQ ID NOS: 157 to 161, respectively, and a polynucleotide comprising a nucleotide sequence complementary thereto.

The kit of the present invention can include any combination of the two or more polynucleotides.

Specific examples of such combinations include: a polynucleotide comprising a nucleotide sequence as shown in SEQ ID NO: 142 or 143 or a complementary sequence thereof, a polynucleotide hybridizing under stringent conditions to such polynucleotide, and/or a fragment thereof, a polynucleotide comprising a nucleotide sequence as shown in any of SEQ ID NOS: 142 to 144 or a complementary sequence thereof, a polynucleotide hybridizing under stringent conditions to such polynucleotide, and/or a fragment thereof, a polynucleotide comprising a nucleotide sequence as shown in any of SEQ ID NOS: 142 to 145 or a complementary sequence thereof, a polynucleotide hybridizing under stringent conditions to such polynucleotide, and/or a fragment thereof, a polynucleotide comprising a nucleotide sequence as shown in any of SEQ ID NOS: 142 to 146 or a complementary sequence thereof, a polynucleotide hybridizing under stringent conditions to such polynucleotide, and/or a fragment thereof, a polynucleotide comprising a nucleotide sequence as shown in any of SEQ ID NOS: 142 to 147 or a complementary sequence thereof, a polynucleotide hybridizing under stringent conditions to such polynucleotide, and/or a fragment thereof, a polynucleotide comprising a nucleotide sequence as shown in any of SEQ ID NOS: 142 to 148 or a complementary sequence thereof, a polynucleotide hybridizing under stringent conditions to such polynucleotide, and/or a fragment thereof, a polynucleotide comprising a nucleotide sequence as shown in any of SEQ ID NOS: 142 to 149 or a complementary sequence thereof, a polynucleotide hybridizing under stringent conditions to such polynucleotide, and/or a fragment thereof, a polynucleotide comprising a nucleotide sequence as shown in any of SEQ ID NOS: 142 to 150 or a complementary sequence thereof, a polynucleotide hybridizing under stringent conditions to such polynucleotide, and/or a fragment thereof, a polynucleotide comprising a nucleotide sequence as shown in any of SEQ ID NOS: 142 to 151 or a complementary sequence thereof, a polynucleotide hybridizing under stringent conditions to such polynucleotide, or a fragment thereof, a polynucleotide comprising a nucleotide sequence as shown in any of SEQ ID NOS: 142 to 152 or a complementary sequence thereof, a polynucleotide hybridizing under stringent conditions to such polynucleotide, and/or a fragment thereof, a polynucleotide comprising a nucleotide sequence as shown in any of SEQ ID NOS: 142 to 153 or a complementary sequence thereof, a polynucleotide hybridizing under stringent conditions to such polynucleotide, and/or a fragment thereof; a polynucleotide comprising a nucleotide sequence as shown in any of SEQ ID NOS: 142 to 154 or a complementary sequence thereof, a polynucleotide hybridizing under stringent conditions to such polynucleotide, and/or a fragment thereof; a polynucleotide comprising a nucleotide sequence as shown in any of SEQ ID NOS: 142 to 155 or a complementary sequence thereof, a polynucleotide hybridizing under stringent conditions to such polynucleotide, and/or a fragment thereof; a polynucleotide comprising a nucleotide sequence as shown in any of SEQ ID NOS: 142 to 156 or a complementary sequence thereof and/or a fragment thereof; a polynucleotide comprising a nucleotide sequence as shown in any of SEQ ID NOS: 142 to 157 or a complementary sequence thereof, a polynucleotide hybridizing under stringent conditions to such polynucleotide and/or a fragment thereof; a polynucleotide comprising a nucleotide sequence as shown in any of SEQ ID NOS: 142 to 158 or a complementary sequence thereof, a polynucleotide hybridizing under stringent conditions to such polynucleotide, and/or a fragment thereof; a polynucleotide comprising a nucleotide sequence as shown in any of SEQ ID NOS: 142 to 159 or a complementary sequence thereof, a polynucleotide hybridizing under stringent conditions to such polynucleotide, and/or a fragment thereof; a polynucleotide comprising a nucleotide sequence as shown in any of SEQ ID NOS: 142 to 160 or a complementary sequence thereof, a polynucleotide hybridizing under stringent conditions to such polynucleotide, and/or a fragment thereof; and a polynucleotide comprising a nucleotide sequence as shown in any of SEQ ID NOS: 142 to 161 or a complementary sequence thereof, a polynucleotide hybridizing under stringent conditions to such polynucleotide, and/or a fragment thereof.

According to a more preferable embodiment, the kit of the present invention can comprise at least two or all polynucleotides of the polynucleotides comprising the nucleotide sequences as shown in SEQ ID NOS: 162 to 181 or complementary sequences thereof.

A specific example of another combination is polynucleotides comprising (or consisting of) the nucleotide sequences as shown in SEQ ID NOS: 162 to 165, 167, 171, 173, 174, and 176 or complementary sequences thereof, and/or fragments thereof.

A specific example of another combination is polynucleotides comprising (or consisting of) the nucleotide sequences as shown in SEQ ID NOS: 162 to 166, 168 to 172, and 175 or complementary sequences thereof, and/or fragments thereof.

According to the present invention, the size of fragments of the polynucleotides of group I and of group II is, for example, continuous 15 to all nucleotides, 15 to 5,000 nucleotides, 15 to 4,500 nucleotides, 15 to 4,000 nucleotides, 15 to 3,500 nucleotides, 15 to 3,000 nucleotides, 15 to 2,500 nucleotides, 15 to 2,000 nucleotides, 15 to 1,500 nucleotides, 15 to 1,000 nucleotides, 15 to 900 nucleotides, 15 to 800 nucleotides, 15 to 700 nucleotides, 15 to 600 nucleotides, 15 to 500 nucleotides, 15 to 400 nucleotides, 15 to 300 nucleotides, 15 to 250 nucleotides, 15 to 200 nucleotides, 15 to 150 nucleotides, 15 to 140 nucleotides, 15 to 130 nucleotides, 15 to 120 nucleotides, 15 to 110 nucleotides, 15 to 100 nucleotides, 15 to 90 nucleotides, 15 to 80 nucleotides, 15 to 70 nucleotides, 15 to 60 nucleotides, 15 to 50 nucleotides, 15 to 40 nucleotides, 15 to 30 nucleotides, or 15 to 25 nucleotides; 25 to all nucleotides, 25 to 1000 nucleotides, 25 to 900 nucleotides, 25 to 800 nucleotides, 25 to 700 nucleotides, 25 to 600 nucleotides, 25 to 500 nucleotides, 25 to 400 nucleotides, 25 to 300 nucleotides, 25 to 250 nucleotides, 25 to 200 nucleotides, 25 to 150 nucleotides, 25 to 140 nucleotides, 25 to 130 nucleotides, 25 to 120 nucleotides, 25 to 110 nucleotides, 25 to 100 nucleotides, 25 to 90 nucleotides, 25 to 80 nucleotides, 25 to 70 nucleotides, 25 to 60 nucleotides, 25 to 50 nucleotides or 25 to 40 nucleotides; 50 to all nucleotides, 50 to 1000 nucleotides, 50 to 900 nucleotides, 50 to 800 nucleotides, 50 to 700 nucleotides, 50 to 600 nucleotides, 50 to 500 nucleotides, 50 to 400 nucleotides, 50 to 300 nucleotides, 50 to 250 nucleotides, 50 to 200 nucleotides, 50 to 150 nucleotides, 50 to 140 nucleotides, 50 to 130 nucleotides, 50 to 120 nucleotides, 50 to 110 nucleotides, 50 to 100 nucleotides, 50 to 90 nucleotides, 50 to 80 nucleotides, 50 to 70 nucleotides, or 50 to 60 nucleotides; or 60 to all nucleotides, 60 to 1000 nucleotides, 60 to 900 nucleotides, 60 to 800 nucleotides, 60 to 700 nucleotides, 60 to 600 nucleotides, 60 to 500 nucleotides, 60 to 400 nucleotides, 60 to 300 nucleotides, 60 to 250 nucleotides, 60 to 200 nucleotides, 60 to 150 nucleotides, 60 to 140 nucleotides, 60 to 130 nucleotides, 60 to 120 nucleotides, 60 to 110 nucleotides, 60 to 100 nucleotides, 60 to 90 nucleotides, 60 to 80 nucleotides, or 60 to 70 nucleotides, in the nucleotide sequence of each polynucleotide.

It should be noted that the above combinations that constitute the kit of the present invention are exemplary, and any other combinations fall within the scope of the present invention.

The kit of the present invention can comprise, in addition to the polynucleotides of the present invention, mutants thereof, or fragments thereof as described above, known or novel polynucleotides that enable detection of esophageal cancer.

4.2 Antibody Kit

The present invention also provides a kit for detecting, determining, or predicting in vitro the presence or metastasis of esophageal cancer, comprising one or more of the antibodies of group III described in Section 2 above, fragments thereof, chemically modified derivatives thereof, the antibodies described in Section 3.3 above, fragments thereof, or chemically modified derivatives thereof.

The kit of the present invention can comprise, as probes, antibodies from groups III (k), (l), and (m), fragments thereof, or chemically modified derivatives thereof. These probes can be packaged in suitable containers alone or in combination.

Examples of Probe Combinations are as Follows.

The first example comprises one or more antibodies against the polypeptides encoded by the genes shown below, mutants thereof, or fragments thereof, for detecting metastasis markers of esophageal cancer, i.e., polypeptides encoded by the AXL, C6orf54, ZBTB11, TNFRSF14, NSUN5, SPEN, LTBP3, SYNGR1, ARL3, SLC13A1, RALGDS, ADD3, MAP3K12, AVPI1, GIMAP6, FLJ11259, C3AR1, PCGF2, PDE6D, PLCG2, GPR148, ARF6, NISCH, GLYAT, IGHM, FBXO38, SLC12A1, PGDS, CD48, IMPA2, HSPA6, EIF3S9, ZNF659, RAB6C, NOL1, DAB2, EBI3, PRSS3, GLB1, SAMSN1, AQP3, CAPZA2, B4GALT2, ARHGEF3, POGK, PRAF1, and HPGD genes, homologs thereof, mutants thereof, or derivatives thereof. These probes can be used for detecting, determining, or predicting the presence and/or metastasis of esophageal cancer. Prediction of metastasis can be led to prediction of prognosis of the patient after surgery.

Specifically, the probes comprised in the kit are: one or more antibodies that bind specifically to at least one of polypeptides comprising the amino acid sequences as shown in SEQ ID NOS: 95 to 140, mutants thereof, or fragments thereof, fragments thereof, or chemically modified derivatives.

The kit can further comprise an antibody against a polypeptide having the amino acid sequence as shown in SEQ ID NO: 141, a fragment thereof, or a chemically modified derivative thereof. Use of such antibodies in combination can improve the accuracy for predicting metastasis or prognosis after surgery.

The second example includes one or more antibodies against the polypeptides encoded by the following genes, mutants thereof, or fragments thereof for detecting the esophageal cancer markers, i.e., the polypeptides encoded by the GALNS, fgf3, CAMK2B, CaMKIINalpha, PSARL, XRCC3, CAPG, GRHPR, TROAP, RRM2, SATB2, C14orf162, SEPT6, M6PR, SPRR3, EML1, YPEL5, EIF4EBP2, SLC2A14, and SLIT2 genes, homologs thereof, mutant thereof, or derivatives thereof, alone or in combination. Such probes can be used for detecting, determining, or predicting the presence of esophageal cancer.

Specifically, the probes comprised in the kit are: one or more antibodies binding specifically to at least one polypeptide having an amino acid sequence as shown in any of SEQ ID NOS: 182 to 195 and 197 to 201, a mutant thereof, or a fragment thereof, fragments thereof, or chemically modified derivatives thereof.

The kit can further comprise an antibody against a polypeptide having the amino acid sequence as shown in SEQ ID NO: 196, a fragment thereof, or a chemically modified derivative thereof.

The third example is: one or more antibodies binding specifically to at least one polypeptide having an amino acid sequence as shown in any of SEQ ID NOS: 202 to 232, a mutant thereof, or a fragment thereof, a fragment thereof, or a chemically modified derivative thereof.

The kit can further comprise an antibody against a polypeptide having the amino acid sequence as shown in SEQ ID NO: 233, a fragment thereof, or a chemically modified derivative thereof.

The antibodies comprised in the kit of the present invention can be present singly or in the form of a mixture. Alternatively, the antibodies may be bound onto a solid-phase carrier or may be in the free from. Further, the kit of the present invention can comprise a labeled secondary antibody, a carrier, a washing buffer, a sample diluent, a substrate for enzyme, a reaction terminator, a marker (target) polypeptide(s) as purified standard(s), instructions, and so on.

5. DNA Chip

The present invention further provides a DNA chip for detecting, determining, or predicting in vitro the presence or metastasis of esophageal cancer using the same polynucleotide(s) as the polynucleotide(s) comprised in the composition and/or the kit of the present invention as described in Sections 3 and/or 4 above, a mutant(s) thereof, or a fragment(s) thereof, alone or in combination, preferably in combination.

A substrate of the DNA chip is not particularly limited, provided that the substrate can comprise DNAs immobilized thereon. Examples of the substrate include a glass slide, a silicon chip, a polymer chip, and a nylon membrane. Such substrates may be subjected to surface treatment, for example, poly-L-lysine coating or introduction of a functional group like amino group or carboxyl group.

DNA can be immobilized on a substrate by any common techniques without particular limitation. Examples of such techniques include a method wherein DNA is spotted using a high-density dispenser, called spotteror arrayer, a method of spraying DNA on a substrate using an apparatus (i.e., inkjet), which jets fine droplets from a nozzle by a piezoelectric element, and a method of synthesizing nucleotides successively on a substrate. When the high-density dispenser is used, for example, different gene solutions are first placed into each well of a multiwell plate, and the solutions are taken out of the plate using a pin (i.e., needle) and are successively spotted on the substrate. According to the inkjet technique, genes are jetted through a nozzle, and the genes are arrayed on the substrate at a high speed. In the DNA synthesis on the substrate, a nucleotide on the substrate is protected with a functional group, which is capable of leaving from the substrate by light, and light is selectively applied only to a nucleotide at a specific position by using a mask, thereby deprotecting the functional group. Thereafter, nucleotides are added to the reaction mixture, which nucleotides are coupled to the nucleotides on the substrate, and this step is repeated.

Polynucleotides to be immobilized are the polynucleotides of the present invention as described above.

Examples of such polynucleotides can comprise one or more of the following polynucleotides or fragments thereof:

(1) polynucleotides consisting of the respective nucleotide sequences as shown in SEQ ID NOS: 1 to 46 and 47, mutants thereof, or fragments thereof comprising at least 15 continuous nucleotides;

(2) polynucleotides comprising the respective nucleotide sequences as shown in SEQ ID NOS: 1 to 46 and 47;

(3) polynucleotides consisting of the respective nucleotide sequences as shown in SEQ ID NOS: 1 to 46, mutants thereof, or fragments thereof comprising at least 15 continuous nucleotides;

(4) polynucleotides comprising the respective nucleotide sequences as shown in SEQ ID NOS: 1 to 46, mutants thereof, or fragments thereof comprising at least 15 continuous nucleotides;

(5) polynucleotides consisting of nucleotide sequences complementary to the respective nucleotide sequences as shown in SEQ ID NOS: 1 to 46, mutants thereof, or fragments thereof comprising at least 15 continuous nucleotides;

(6) polynucleotides comprising nucleotide sequences complementary to the respective nucleotide sequences as shown in SEQ ID NOS: 1 to 46;

(7) polynucleotides hybridizing under stringent conditions to DNAs consisting of nucleotide sequences complementary to the respective nucleotide sequences as shown in SEQ ID NOS: 1 to 46, or fragments thereof comprising at least 15 continuous nucleotides;

(8) polynucleotides hybridizing under stringent conditions to DNAs consisting of the respective nucleotide sequences as shown in SEQ ID NOS: 1 to 46, or fragments thereof comprising at least 15 continuous nucleotides;

(9) a polynucleotide consisting of the nucleotide sequence as shown SEQ ID NO: 47, a mutant thereof, or a fragment thereof comprising at least 15 continuous nucleotides;

(10) a polynucleotide comprising the nucleotide sequence as shown in SEQ ID NO: 47, a mutant thereof, or a fragment thereof comprising at least 15 continuous nucleotides;

(11) a polynucleotide consisting of a nucleotide sequence complementary to the nucleotide sequence as shown in SEQ ID NO: 47, a mutant thereof, or a fragment thereof comprising at least 15 continuous nucleotides;

(12) a polynucleotide comprising a nucleotide sequence complementary to the nucleotide sequence as shown in SEQ ID NO: 47;

(13) a polynucleotide hybridizing under stringent conditions to DNA consisting of a nucleotide sequence complementary to the nucleotide sequence as shown in SEQ ID NO: 47 or a fragment thereof comprising at least 15 continuous nucleotides;

(14) a polynucleotide hybridizing under stringent conditions to DNA consisting of the nucleotide sequence as shown in SEQ ID NO: 47, or a fragment thereof comprising at least 15 continuous nucleotides;

(15) polynucleotides comprising at least 15 continuous nucleotides in each of the nucleotide sequences as shown in SEQ ID NOS: 1 to 46 or complementary sequences thereof;

(16) polynucleotides comprising at least 60 continuous nucleotides in each of the nucleotide sequences as shown in SEQ ID NOS: 1 to 46 or complementary sequences thereof;

(17) polynucleotides comprising at least 15 continuous nucleotides in the nucleotide sequence as shown in SEQ ID NO: 47 or a complementary sequence thereof

(18) polynucleotides comprising at least 60 continuous nucleotides in the nucleotide sequence as shown in SEQ ID NO: 47 or a complementary sequence thereof;

(19) polynucleotides comprising the respective nucleotide sequences as shown in SEQ ID NOS: 48 to 93 and comprising at least 60 continuous nucleotides in the nucleotide sequences as shown in SEQ ID NOS: 1 to 46;

(20) polynucleotides comprising nucleotide sequences complementary to the nucleotide sequences as shown in SEQ ID NOS: 48 to 93 and comprising at least 60 continuous nucleotides in the respective nucleotide sequences complementary to the nucleotide sequences as shown in SEQ ID NOS: 1 to 46, respectively;

(21) a polynucleotide comprising the nucleotide sequence as shown in SEQ ID NO: 94 and comprising at least 60 continuous nucleotides in the nucleotide sequence as shown in SEQ ID NO: 47; and

(22) a polynucleotide comprising a nucleotide sequence complementary to the nucleotide sequence as shown in SEQ ID NO: 94 and comprising at least 60 continuous nucleotides in the nucleotide sequence complementary to the nucleotide sequence as shown in SEQ ID NO: 47.

According to a preferable embodiment, the DNA chip of the present invention can comprise at least two or all polynucleotides each comprising a nucleotide sequence as shown in any of SEQ ID NOS: 48 to 94 or a complementary sequence thereof.

According to the other embodiment, a polynucleotide that can bind to the DNA chip can comprise one or more of the following polynucleotides or fragments thereof (1) polynucleotides consisting of the respective nucleotide sequences as shown in SEQ ID NOS: 142 to 161, mutants thereof, or fragments thereof comprising at least 15 continuous nucleotides;

(2) polynucleotides comprising the respective nucleotide sequences as shown in SEQ ID NOS: 142 to 161;

(3) polynucleotides consisting of the respective nucleotide sequences as shown in SEQ ID NOS: 142 to 155, mutants thereof, or fragments thereof comprising at least 15 continuous nucleotides;

(4) polynucleotides comprising the respective nucleotide sequences as shown in SEQ ID NOS: 142 to 155, mutants thereof, or fragments thereof comprising at least 15 continuous nucleotides;

(5) polynucleotides consisting of nucleotide sequences complementary to the respective nucleotide sequences as shown in SEQ ID NOS: 142 to 155, mutants thereof, or fragments thereof comprising at least 15 continuous nucleotides;

(6) polynucleotides comprising nucleotide sequences complementary to the respective nucleotide sequences as shown in SEQ ID NOS: 142 to 155;

(7) polynucleotides hybridizing under stringent conditions to DNAs consisting of nucleotide sequences complementary to the respective nucleotide sequences as shown in SEQ ID NOS: 142 to 155 or fragments thereof comprising at least 15 continuous nucleotides;

(8) polynucleotides hybridizing under stringent conditions to DNAs consisting of the respective nucleotide sequence as shown in SEQ ID NOS: 142 to 155, or fragments thereof comprising at least 15 continuous nucleotides;

(9) polynucleotides consisting of the respective nucleotide sequences as shown in SEQ ID NOS: 157 to 161, mutants thereof, or fragments thereof comprising at least 15 continuous nucleotides;

(10) polynucleotides comprising the respective nucleotide sequences as shown in SEQ ID NOS: 157 to 161, mutants thereof, or fragments thereof comprising at least 15 continuous nucleotides;

(11) polynucleotides consisting of nucleotide sequences complementary to the respective nucleotide sequences as shown in any of SEQ ID NOS: 157 to 161, mutants thereof, or fragments thereof comprising at least 15 continuous nucleotides;

(12) polynucleotides comprising nucleotide sequences complementary to the respective nucleotide sequences as shown in SEQ ID NOS: 157 to 161;

(13) polynucleotides hybridizing under stringent conditions to DNAs consisting of nucleotide sequences complementary to the respective nucleotide sequences as shown in SEQ ID NOS: 157 to 161, or fragments thereof comprising at least 15 continuous nucleotides;

(14) polynucleotides hybridizing under stringent conditions to DNAs consisting of the respective nucleotide sequences as shown in SEQ ID NOS: 157 to 161, or fragments thereof comprising at least 15 continuous nucleotides;

(15) polynucleotides comprising at least 15 continuous nucleotides in the respective nucleotide sequences as shown in SEQ ID NOS: 142 to 155 or complementary sequences thereof;

(16) polynucleotides comprising at least 60 continuous nucleotides in the respective nucleotide sequences as shown in SEQ ID NOS: 142 to 155 or complementary sequences thereof;

(17) polynucleotides comprising at least 15 continuous nucleotides in the respective nucleotide sequences as shown in SEQ ID NOS: 157 to 161 or complementary sequences thereof;

(18) polynucleotides comprising at least 60 continuous nucleotides in the respective nucleotide sequences as shown in SEQ ID NOS: 157 to 161 or complementary sequences thereof;

(19) polynucleotides comprising the nucleotide sequences as shown in SEQ ID NOS: 162 to 175 and comprising at least 60 continuous nucleotides in the nucleotide sequences as shown in SEQ ID NOS: 142 to 155, respectively;

(20) polynucleotides comprising nucleotide sequences complementary to the nucleotide sequences as shown in SEQ ID NOS: 162 to 175 and comprising at least 60 continuous nucleotides in the nucleotide sequences as shown in SEQ ID NOS: 142 to 155, respectively, or complementary sequences thereof;

(21) polynucleotides comprising the nucleotide sequences as shown in SEQ ID NOS: 177 to 181 and comprising at least 60 continuous nucleotides in the nucleotide sequences as shown in SEQ ID NOS: 157 to 161, respectively;

(22) polynucleotides comprising nucleotide sequences complementary to the nucleotide sequences as shown in SEQ ID NOS: 177 to 181 and comprising at least 60 continuous nucleotides in the nucleotide sequences complementary to the nucleotide sequences as shown in SEQ ID NOS: 157 to 161, respectively;

(23) a polynucleotide consisting of the nucleotide sequence as shown in of SEQ ID NO: 156, a mutant thereof, or a fragment thereof comprising at least 15 continuous nucleotides;

(24) a polynucleotide comprising the nucleotide sequence as shown in SEQ ID NO: 156, a mutant thereof, or a fragment thereof comprising at least 15 continuous nucleotides;

(25) a polynucleotide consisting of a nucleotide sequence complementary to the nucleotide sequence as shown in SEQ ID NO: 156, a mutant thereof, or a fragment thereof comprising at least 15 continuous nucleotides;

(26) a polynucleotide comprising a nucleotide sequence complementary to the nucleotide sequence as shown in SEQ ID NO: 156;

(27) a polynucleotide hybridizing under stringent conditions to DNA consisting of a nucleotide sequence complementary to the nucleotide sequence as shown in SEQ ID NO: 156, or a fragment thereof comprising at least 15 continuous nucleotides;

(28) a polynucleotide hybridizing under stringent conditions to DNA consisting of the nucleotide sequence as shown in SEQ ID NO: 156, or a fragment thereof comprising at least 15 continuous nucleotides;

(29) polynucleotides comprising at least 15 continuous nucleotides in the nucleotide sequence as shown in SEQ ID NO: 156 or a complementary sequence thereof;

(30) polynucleotides comprising at least 60 continuous nucleotides in the nucleotide sequence as shown in SEQ ID NO: 156 or a complementary sequence thereof;

(31) a polynucleotide comprising the nucleotide sequence as shown in SEQ ID NOS: 176 and comprising at least 60 continuous nucleotides in the nucleotide sequence as shown in SEQ ID NO: 156; and

(32) a polynucleotide comprising a sequence complementary to the nucleotide sequence as shown in SEQ ID NO: 176 and comprising at least 60 continuous nucleotides in the nucleotide sequence complementary to the nucleotide sequence as shown in SEQ ID NO: 156.

According to a preferable embodiment, the DNA chip of the present invention can include at least 2 or all polynucleotides each comprising a nucleotide sequence as shown in any of SEQ ID NOS: 162 to 181 or a complementary sequence thereof.

According to the present invention, the polynucleotides to be immobilized may be any of genomic DNA, cDNA, RNA (e.g., mRNA, cRNA, or aRNA), synthetic DNA, and synthetic RNA, or alternatively they may be single-stranded or double-stranded.

Examples of DNA chips that can detect and assay the expression levels of the target gene, RNA, or cDNA include the Gene Chip Human Genome U133 Plus 2.0 Array (Affymetrix), the Whole human genome oligo microarray (Agilent), the IntelliGene® HS Human Expression CHIP (Takara Bio), and a polymethylmethacrylate DNA chip substrate having a concave-convex structure (JP Patent Publication (kokai) No. 2004-264289 A).

DNA microarrays can be prepared by, for example, a method wherein probes that have been prepared in advance are immobilized on a solid-phase surface. In this method, polynucleotides into which functional groups have been introduced are synthesized, and oligonucleotides or polynucleotides are spot-deposited on the surface of a surface-treated solid-phase support, followed by covalent binding to the surface (e.g., J. B. Lamture et al., Nucleic. Acids. Research, 1994, vol. 22, pp. 2121-2125; Z. Guo et al., Nucleic. Acids. Research, 1994, vol. 22, pp. 5456-5465). In general, the polynucleotides are covalently bound to the surface-treated solid-phase support via a spacer or crosslinker. The method wherein fine pieces of polyacrylamide gel are aligned on the glass surface and synthetic polynucleotides are covalently bound thereto is also known (G. Yershov et al., Proceedings of the National Academic Sciences, U.S.A., 1996, vol. 94, p. 4913). As a further method, a microelectrode array is prepared on silica microarray, on which electrode is formed a reaction site by making a permeable layer of streptavidin-containing agarose, where this site is positively charged to immobilize the biotinylated polynucleotides thereon and the charge at the site is regulated, then this makes the stringent hybridization at a high speed possible (R. G Sosnowski et al., Proceedings of the National Academic Sciences, U.S.A., 1997, vol. 94, pp. 1119-1123).

6. Method for Detecting, Determining, or Predicting the Presence or Metastasis of Esophageal Cancer The present invention provides a method for detecting, determining, or predicting in vitro the presence and/or metastasis of esophageal cancer comprising assaying the presence, existing amount, or expression level of one or more esophageal cancer-associated target nucleic acids in a biological sample from a subject, by using one or more probes selected from the probes of group I, group II, and/or group III as defined above, the composition, the kit, or the DNA chip of the present invention, or combinations thereof.

The polynucleotides of group I and the antibodies, fragments thereof, or chemically modified derivatives thereof of group III (k) can be used for detecting, determining, or predicting the presence and/or metastasis of esophageal cancer.

The polynucleotides of group II and the antibodies, fragments thereof, or chemically modified derivatives thereof of groups II (l) and (m) can be used for detecting, determining, or predicting the presence of esophageal cancer.

According to the method of the present invention, the presence or metastasis of esophageal cancer can be detected, determined, or predicted by using changes from a control sample as an indicator.

In order to determine whether or not the biological sample from a subject contains esophageal cancer cells or metastatic esophageal cancer cells in vitro, for example, the expression level of the target nucleic acid of the cell in the biological sample is compared with that in the corresponding normal tissue or non-cancerous esophageal tissue, or the esophageal cancer tissue from patients without post-surgery metastasis. When the expression level changes (i.e., increases or decreases), it can be determined that the biological sample comprises esophageal cancer cells or metastatic esophageal cancer cells.

The present invention also provides use of one or more probes selected from the probes of group I, group II, and/or group III as defined above or the composition, the kit, or the DNA chip of the present invention, for detecting, determining, or predicting in vitro the presence or metastasis of esophageal cancer in a biological sample from a subject.

In the method for detecting, determining, predicting, or (genetically) diagnosing the presence or metastasis of esophageal cancer of the present invention, probes for diagnosing esophageal cancer comprising the polynucleotides comprised in the composition, kit, or DNA chip of the present invention, mutants thereof, or fragments thereof can be used as primers or detection probes. When used as primers, for example, primers comprising generally 15 to 50 nucleotides, preferably 15 to 30 nucleotides, and more preferably 18 to 25 can be used. When used as detection probes, for example, polynucleotides comprising 15 to all nucleotides, preferably 25 to 1000 nucleotides, more preferably 25 to 100 nucleotides can be used. It should be understood, however, that the number of nucleotides is not limited to the specific ranges.

The polynucleotides, mutants thereof, or fragments thereof that are comprised in the composition or kit of the present invention can be used as primers or probes in accordance with the conventional techniques in known methods for specifically detecting a given gene, such as Northern blotting, Southern blotting, RT-PCR, in situ hybridization, or Southern hybridization. As to samples to be tested (or analytes), the whole or part of the esophageal tissue or the body tissue suspected of having esophageal cancer cells of a subject may be removed by biopsy or another means, or the samples may be removed from the body tissue excised by surgery, depending on types of detection methods. Further, total RNA prepared therefrom in accordance with the conventional techniques may be used, or various polynucleotides including cDNA or poly A(+) RNA prepared from the RNA may be used.

Also, the expression levels of nucleic acids such as the gene, RNA, or cDNA of the present invention in the body tissue can be detected or quantified using a DNA chip (including a DNA microarray). In this case, the composition or kit of the present invention can be used as a DNA array probe (e.g., the Human Genome U133 Plus 2.0 Array (Affymetrix) uses a polynucleotide probe having 25 nucleotides). Such a DNA array may be hybridized to the labeled DNA or RNA, which is prepared from RNA removed from the body tissue, and a complex of the probe with the labeled DNA or RNA resulting from such hybridization may be detected using the labeled DNA or RNA as an indicator to evaluate the occurrence of the expression of the esophageal cancer-associated genes or esophageal cancer-metastasis-associated genes or the expression levels thereof in the body tissue. In the method of the present invention, a DNA chip is preferably used. This enables the simultaneous evaluation of the presence or absence of the expression of a plurality of genes, or the simultaneous evaluation of the expression levels of the genes, in a single biological sample.

The composition, kit, or DNA chip of the present invention is useful for diagnosing, i.e., for detecting, determining, or predicting, the presence or metastasis of esophageal cancer (e.g., diagnosis of affection or degree of affection). Specifically, the presence or metastasis of esophageal cancer can be diagnosed using the composition, kit, or DNA chip in the following manner. That is, the body tissue of the subject having esophageal cancer cells, the esophageal cancer tissue of the patient in which the metastasis to lymph node was not observed at surgery and/or the esophageal cancer tissue of the patient in which the metastasis to lymph node was observed at surgery are compared, or alternatively, the body tissue of the patient in which the metastasis to lymph node was not observed at surgery and/or the body tissue of the patient in which the metastasis to lymph node was observed at surgery are compared, and differences in gene expression levels detected with the use of the diagnostic compositions are determined. Thus, the diagnosis of interest can be performed. In this case, the term “differences in gene expression levels” refers to not only the presence or absence of the expression but also the case where differences in gene expression levels between the body tissue comprising esophageal cancer cells and the normal tissue, or between the body tissue having metastatic esophageal cancer cells and the body tissue having non-metastatic esophageal cancer cells, are statistically significant (p value of $<0.05$). For example, the expression of the SPRR3 gene is induced/decreased in the presence of esophageal cancer, and thus, this gene is expressed/decreased in the esophageal cancer tissue of the subject. If the differences between the expression level in the cancer tissue and the expression level in the normal tissue are significant, the subject is suspected of having esophageal cancer. Also, the expression of, for example, the HPGD gene is induced/decreased in the presence of metastatic esophageal cancer, and thus, this gene is expressed/decreased in the esophageal cancer tissue of the subject. If the differences between the expression level in the metastatic cancer tissue and the expression level in the body tissue having non-metastatic esophageal cancer cells are significant, the subject is suspected of having the metastasis of esophageal cancer.

A method for detecting esophageal cancer (cells) or metastatic esophageal cancer (cells) using the composition, kit, or DNA chip of the present invention comprises: removing the whole or part of the body tissue from a subject via biopsy or recovering it from the body tissue excised by surgery; detecting the genes contained therein using a polynucleotide or polynucleotides selected from the polynucleotide probes of the present invention, mutants thereof, or fragments thereof; measuring the expression levels of said genes; and diagnosing the presence or absence of affection with esophageal cancer or a degree thereof, or the presence of the metastasis of esophageal cancer or a degree thereof. Also, the method for detecting esophageal cancer or metastasis of esophageal cancer according to the present invention can detect, determine, or predict the presence or absence or the degree of amelioration of the disease when a therapeutic agent is administered to an esophageal cancer bearing patient, for example.

The method of the present invention can comprise, for example, the following steps (a), (b), and (c) of:

(a) bringing a biological sample of a subject into contact with a polynucleotide or polynucleotides comprised in the composition, kit, or DNA chip of the present invention;

(b) measuring the expression level of the target nucleic acid(s) in the biological sample using the polynucleotide or polynucleotides as the probe; and (c) determining the presence or absence of esophageal cancer (cells) or metastatic esophageal cancer (cells) in the biological sample on the basis of the results obtained in step (b).

Examples of biological samples used in the method of the present invention include the body tissues of a subject, for example, samples prepared from esophageal tissue and peripheral tissue thereof, tissue suspected of having the metastasis of esophageal cancer, and the like. Specifically, an RNA containing sample prepared from such tissue or a sample containing a polynucleotide prepared therefrom may be prepared by removing the whole or part of the body tissue from the subject via biopsy, or recovering the sample from the body tissue excised by surgery to prepare the sample therefrom in accordance with conventional techniques.

The term "subject" as used herein refers to a mammalian animal. Examples thereof include, but are not limited to, human, monkey, mouse, and rat, preferably human.

In the method of the present invention, the above-mentioned steps may be varied depending on types of biological samples used as an analyte.

When RNA is used as the analyte, for example, detection of esophageal cancer (cells) or metastatic esophageal cancer (cells) can comprise, for example, the following steps (a), (b), and (c) of:

(a) allowing RNA prepared from a biological sample of a subject or a complementary polynucleotide (cDNA) transcribed therefrom to bind to a polynucleotide comprised in the composition, kit, or DNA chip of the present invention;

(b) measuring the RNA prepared from the biological sample bound to the polynucleotide or a complementary polynucleotide transcribed from the RNA using the above polynucleotide as a probe; and (c) determining the presence or absence of esophageal cancer (cells) or metastatic esophageal cancer (cells) based on the results obtained in step (b).

In order to detect, determine, or diagnose the esophageal cancer (cells) or metastatic esophageal cancer (cells) by the method of the present invention, for example, various hybridization techniques can be employed. Examples of the hybridization techniques that can be employed include Northern blotting, Southern blotting, RT-PCR, DNA chip analysis, in situ hybridization, and Southern hybridization.

When Northern blotting is employed, the composition of the present invention can be used as a probe to detect and determine the presence or absence of gene expression in RNA or the expression level thereof. Specifically, the diagnostic composition (specifically a complementary strand) of the present invention is labeled with a radioisotope (e.g., $^{32}P$, $^{33}P$, or $^{35}S$) or a fluorophore, the resultant is hybridized to the RNA obtained from a body tissue of a subject that has been transferred onto a nylon membrane or the like in accordance with any of the conventional techniques, the resulting double-strand of the diagnostic composition (i.e., DNA) and RNA can be detected and measured by detecting a signal derived from a label (a radioisotope or fluorophore) of the diagnostic composition using a radio detector (e.g., BAS-1800 II, Fuji Photo Film, Japan) or a fluorescent detector using a fluorescent detector (STORM 860, Amersham Bioscience).

When the quantitative RT-PCR is employed, the diagnostic composition of the present invention can be used as a primer to detect and determine the presence or absence of the gene expression in RNA or the expression level thereof. Specifically, cDNA is prepared from RNA of a body tissue of a subject in accordance with a conventional technique, a pair of primers prepared from the composition of the present invention (i.e., a forward strand and a reverse strand, both bound to the cDNA) is hybridized to cDNA to perform PCR with the use of cDNA as a template in accordance with the conventional technique, thereby amplifying the target gene regions, and the resulting double-stranded DNA is detected. Double-stranded DNA can be detected by a method wherein PCR is carried out using a primer that has been labeled with a radioisotope or fluorophore in advance, a method wherein the PCR product is electrophoresed on agarose gel, and double-stranded DNA is detected by staining the same with ethidium bromide or the like, or a method wherein the resulting double-stranded DNA is transferred to a nylon membrane or the like in accordance with a conventional technique, and the resultant is subjected to hybridization to the labeled diagnostic composition as a probe to detect the substance of interest.

When the DNA array analysis is employed, a DNA chip comprising the diagnostic composition of the present invention as a DNA probe (single-stranded or double-stranded) bound to a substrate is used. A substrate comprising genes immobilized thereon is generally referred to as DNA chip or DNA array. Examples of the DNA array include a DNA macroarray and a DNA microarray. As used herein, the term "DNA chip" refers to such DNA arrays.

Hybridization conditions are not particularly limited. For example, hybridization is carried out in 3 to 4×SSC and 0.1% to 0.5% SDS at 30° C. to 50° C. for 1 to 24 hours, more preferably in 3.4×SSC and 0.3% SDS at 40° C. to 45° C. for 1 to 24 hours, followed by washing. Washing is continuously carried out, for example, with a solution containing 2×SSC and 0.1% SDS, with a solution of 1×SSC, and with a solution of 0.2×SSC at room temperature. The term "1×SSC" refers to an aqueous solution containing 150 mM sodium chloride and 15 mM sodium citrate (pH 7.2). Preferably, a complementary strand remains hybridized to the target (+) strand even if it is washed under such conditions. Specific examples of such complementary strand include a strand consisting of the nucleotide sequence completely complementary to the nucleotide sequence of the target (+) strand, and a strand consisting of a nucleotide sequence having at least 80%, at least 85%, at least 90%, at least 95%, or at least 98% identity with said strand.

When PCR is carried out under stringent hybridization conditions using polynucleotide fragments obtained from the composition or kit of the present invention as primers, for example, a PCR buffer comprising 10 mM Tris-HCl (pH 8.3), 50 mM KCl, and 1 to 2 mM $MgCl_2$ is used, and the treatment is carried out at a temperature, Tm+5 to 10° C. which is calculated from the primer sequence, for about 15 seconds to 1 minute. The Tm value can be calculated, for example, by the equation Tm=2×(the number of adenine residues+the number of thymine residues)+4×(the number of guanine residues+the number of cytosine residues).

Another example of the "stringent conditions" for hybridization is described in, for example, Sambrook, J. & Russel, D., Molecular Cloning, A LABORATORY MANUAL, Cold Spring Harbor Laboratory Press, Jan. 15, 2001, vol. 1: 7.42 to 7.45, vol. 2: 8.9 to 8.17, and such conditions can be employed in the present invention.

The present invention also provides a method for determining whether or not esophageal cancer cells or metastatic esophageal cancer cells are contained in a biological sample from a subject, by using a discriminant, i.e., the support vector machine (SVM) which is prepared using the gene expression levels of target nucleic acids or genes between esophageal cancer tissue and normal tissue or between metastatic esophageal cancer tissue and nonmetastatic esophageal cancer tissue as the training samples, wherein the expression levels of the target nucleic acids or genes in the biological sample are measured using one or more probes of group I, group II, and/or group III, the composition, kit, or DNA chip of the present invention, or combinations thereof.

The present invention further provides a method for detecting, determining, or predicting the metastasis of esophageal cancer, the method comprising the steps of:

(1) measuring in vitro the expression levels of esophageal cancer-associated target nucleic acids in a plurality of biological samples that are known to be of either a tissue containing metastatic esophageal cancer cells or a tissue containing non-metastatic esophageal cancer cells using probes selected from group I as defined above or using the composition, kit, or DNA chip of the present invention comprising said probes;

(2) preparing a discriminant (i.e., support vector machine) from the expression levels of the target nucleic acids determined in step (1) as the training samples;

(3) measuring in vitro the expression level of the target nucleic acids in a biological sample from the esophagus of a subject in the same manner as in step (1); and (4) assigning the measured expression levels of the target nucleic acids determined in step (3) to the discriminant prepared in step (2) and determining that the biological sample includes metastatic cancer cells and/or that the biological sample includes non-metastatic cancer cells based on the results obtained from the discriminant.

The present invention further provides a method for detecting esophageal cancer, the method comprising the steps of:

(1) measuring in vitro the expression levels of target nucleic acids in a plurality of biological samples that are known to be an esophageal cancer cell-containing tissue or a normal tissue, by using probes selected from group II as defined above or the composition, kit, or DNA chip of the present invention comprising said probes;

(2) preparing a discriminant (i.e., support vector machines) using the expression levels of the target nucleic acids determined in step (1) as the training samples;

(3) measuring in vitro the expression level of the target nucleic acids in a biological sample from the esophagus of a subject in the same manner as in step (1); and (4) assigning the expression levels of the target nucleic acids (determined in step (3) to the discriminant prepared in step (2), and determining whether or not the biological sample includes cancer cells based on the results obtained from the discriminant.

Alternatively, the method of the present invention can comprise, for example, the following steps (a), (b), and (c) of:

(a) measuring the expression levels of target genes in the biological samples that are known to be either an esophageal cancer cell-containing tissue or a normal tissue, or in the biological samples that are known to be a tissue containing esophageal cancer cells from a patient with metastasis or a tissue containing esophageal cancer cells from a patient without metastasis, by using the composition, kit, or DNA chip of the present invention;

(b) preparing a discriminant, referred to as SVM, by assigning the expression levels determined in (a) into the following equations 1 to 5; and (c) determining whether or not the biological samples comprise esophageal cancer cells or metastatic esophageal cancer cells on the basis of the results obtained by measuring the expression levels of the target genes in biological samples from subjects using the composition, kit, or DNA chip of the present invention and then assigning the determined values to the discriminant prepared in (b).

SVM is a learning machine that was proposed in the framework of a statistical learning theory made to solve a two-class classification problem, by V. Vapnik of AT&T in 1995 (The Nature of Statistical Leaning Theory, Springer, 1995). SVM is a linear classifier but it can solve nonlinear problems in combination with the Kernel method as described below. Among many hyperplanes that classify training samples of different classes, the hyperplane that maximizes the minimum distance from the hyperplane to the training sample may be defined as the classification plane to classify a new test sample in the most accurate manner.

SVM can only solve linear problems. As a method for solving substantially nonlinear problems, a method wherein a feature vector is nonlinearly transformed into a higher-dimensional feature, and linear classification is then performed, is known. This becomes equivalent to the use of a nonlinear model in an original space. High-dimensional mapping, however, requires an enormous computational effort and reduces a generalization capability. According to SVM, the classification function depends exclusively on the inner product of the inputted pattern. Accordingly, if the inner product could be calculated, the optimal classification function could be constructed. The formula that represents the inner product of two elements in a nonlinearly mapped space only by the input in original spaces is referred to as the Kernel formula. An optimal classification function, i.e. a discriminant, can be formed only by the Kernel formula without computation of features in the actually mapped space while performing high-dimensional mapping (e.g., Hideki Asou et al., *Toukei kagaku no furontia* 6 (Frontier of statistical science 6), "*Pataan ninshiki to gakushu no toukeigaku* (Statistics of pattern recognition and learning): *atarashii gainen to shuho* (new concept and procedures)," Iwanami Shoten Publishers, Tokyo, Japan, 2004).

Examples of the computation of a discriminant that can be used in the method of the present invention are shown below.

In order to determine SVM, the expression levels of the target gene in biological samples that are known to be a esophageal cancer cell-containing tissue or a normal tissue is provided as training samples, and a constant of the classification function can be determined in the following manner.

The training sample $x_i$ is assumed to belong to either a group of esophageal cancer cell-containing tissue or a group of normal tissue, which groups are classified into (+1) or (−1). When training samples can be linearly separated by the hyperplane, the classification function is, for example, as follows:

$$f(x) = \sum_{i=1}^{n} w_i \cdot x_i + b \quad \text{[equation 1]}$$

where w represents a weighting factor, b represents a bias constant, and x represents a sample variable.

This function, however, has a restriction:

$$y_i(w^T x_i + b) \geqq 1 - \xi_i$$

$$\xi_i \geqq 0, i=1, \ldots, n \quad \text{[equation 2]}$$

where T represents an inner product, y represents a sample class, and ζ represents a slack variable. Thus, the Lagrange's method of undetermined multipliers may be used to regress to the following optimization problem using the Lagurange multiplier α.

$$\max_{\alpha} \sum_{i=1}^{n} \alpha_i - \frac{1}{2} \sum_{i,j=1}^{n} \alpha_i \alpha_j y_i y_j x_i^T x_j \quad \text{[equation 3]}$$

$$0 \leq \alpha_i \leq C, \sum_{i=1}^{n} \alpha_i y_i = 0 \quad \text{[equation 4]}$$

where C represents a restriction parameter determined by an experiment.

If the above problem is dissolved, the following formula is consequently obtained.

$$w = \sum_{i=1}^{n} \alpha_i y_i x_i \quad \text{[equation 5]}$$

$$b = -\frac{1}{2}(w^T x_A + w^T x_B)$$

Thus, the nonambiguous classification function can be determined. By assigning x concerning a new biological sample (i.e., the gene expression level in a tissue, whether or not the tissue contains esophageal cancer cells is not known) to this function, f(x) can be classified into +1 or −1, and the biological sample can be classified into the group of esophageal cancer cell-containing tissue, the group of normal tissue, the group of tissue containing metastatic esophageal cancer cells from a patient with metastasis, or the group of esophageal cancer tissue without metastasis.

Thus, two groups of training samples are necessary in order to prepare a SVM discriminant for classifying unknown samples. According to the present invention, such training samples are, for example, a set of samples obtained from patients of "the expressed genes ($x_1, x_2, \ldots x_i, \ldots x_n$) obtained from the esophageal cancer tissue of patients who have the esophageal cancer with metastasis" and a set of samples obtained from the patients of "the expressed genes ($x_1, x_2, \ldots x_i, \ldots x_n$) obtained from the esophageal cancer tissue of patients who have esophageal cancer but not metastasis." The number (n) of the expressed genes concerning such sets varies depending on the design of the experiment. The expression levels of each gene yield significant difference, relatively small difference, or no difference between the two groups regardless of the type of experiment. In order to improve the accuracy of the SVM discriminant, distinctive differences are required between 2 groups of training samples. Thus, it is necessary to selectively extract and use genes that exhibit different expression levels between 2 groups from a gene sample sets.

Examples of methods for extracting genes that exhibit different expression levels between 2 groups include a t-test which is a parametric analysis for detecting different means and an U-test of Mann-Whitney which is a non-parametric analysis.

In the method of the present invention, for example, any combination of one or more of the aforementioned polynucleotides as shown in any of SEQ ID NOS: 1 to 46 and 47 and/or one or more of polynucleotides as shown in any of SEQ ID NOS: 1 to 46 and 47 may be used. Also, the fact that the expression levels of the 47 types of target genes in esophageal cancer tissue from a patient with metastasis are significantly different from those in esophageal cancer tissue from a patient without metastasis, and that such expression levels are increased/decreased in esophageal cancer tissue obtained from a patient with metastasis are used as indicators to determine the expression levels of the 47 types of genes. Thus, the metastasis of esophageal cancer can be distinguished at the probability of 70% or higher, 80% or higher, preferably 84% or higher, more preferably 85% or higher, and most preferably 86% or higher (FIG. 1).

Figure 4:
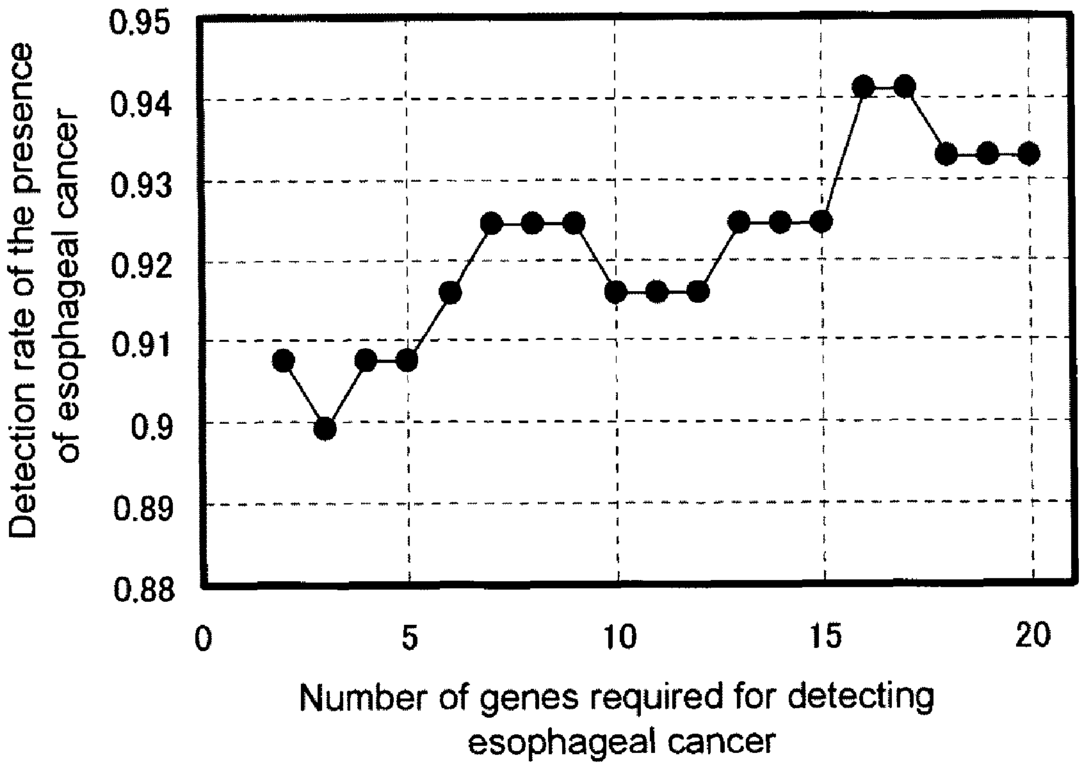
FIG. 4 shows the detection rate of the presence of the esophageal cancer cells detected when the polynucleotides shown in SEQ ID NOS: 162 to 181 which are corresponding to the genes shown in Table 3 were used in combinations. The vertical axis shows the probability of detecting the presence of esophageal cancer tissue in the specimen, and the horizontal axis shows the total number of genes required for detecting esophageal cancer, increased in the order of SEQ ID NOs shown in Table 3.

Also, any combination of one of more of the aforementioned polynucleotides as shown in any of SEQ ID NOS: 142 to 156 and 162 to 176 and/or one or more of polynucleotides as shown in any of SEQ ID NOS: 157 to 161 and 177 to 181 may be used, and the facts that the expression levels of the 20 types of target genes are significantly different between esophageal cancer tissue and non-cancerous tissue, and that the expression levels decreased in esophageal cancer tissue, are used as indicators to measure the expression levels of such 20 types of genes. Thus, esophageal cancer tissues can be distinguished at the probability of 89% or higher, 90% or higher, preferably 92% or higher, more preferably 93% or higher, and most preferably 94% or higher (FIG. 4).

The present invention further provides a method for detecting, determining, or predicting the metastasis of esophageal cancer, comprising measuring in vitro the expression levels of the polypeptides in esophageal cancer tissues or the blood levels (or existing amounts) of the polypeptides between a patient with metastasis and a patient without metastasis, by using one or more antibodies against respective polypeptides encoded by the aforementioned 47 types of genes (e.g., those as shown in SEQ ID NOS: 1 to 47) or fragments thereof (e.g., as shown in SEQ ID NOS: 48 to 94), such as polypeptides consisting of the respective amino acid sequences as shown in SEQ ID NOS: 95 to 141, or fragments thereof.

The present invention also provides a method for detecting, determining, or predicting esophageal cancer, comprising measuring in vitro the expression levels of the polypeptides between esophageal cancer tissue and non-cancerous tissue or the blood levels of the polypeptides (or the existing amounts), by using one or more antibodies against the respective polypeptides encoded by the aforementioned 20 types of genes (e.g., t as shown in SEQ ID NOS: 142 to 161) or fragments thereof (e.g., as shown in SEQ ID NOS: 162 to 181), for example polypeptides consisting of the respective amino acid sequences as shown in SEQ ID NOS: 182 to 201, or fragments thereof.

Specifically, the above mentioned measurement can be carried out by an immunological method.

Examples of immunological assay techniques include enzyme immunoassay (ELISA or EIA), fluorescence immunoassay, radio immunoassay (RIA), luminescent immunoassay, immunonephelometry, latex agglutination assay, latex turbidimetry, hemagglutination, particle agglutination, and Western blotting.

When the above method is carried out by an immunoassay technique using a label, the antibody of the present invention may be immobilized, or a component in the sample may be immobilized to subject such substance to an immunological reaction.

Examples of solid-phase supports that can be used include insoluble supports in the form of beads, microplate, test tube, stick, or specimen comprising a polystyrene, polycarbonate, polyvinyltoluene, polypropyrene, polyethylene, polyvinyl chloride, nylon, polymethacrylate, latex, gelatin, agarose, cellulose, sepharose, glass, metal, ceramic, or magnetic material.

The samples can be immobilized on the support in accordance with a conventional technique by binding the antibody of the present invention or a sample component to the solid-phase support by physical adsorption, chemical binding, or a combination thereof.

The present invention is intended to easily detect the reaction between the antibody of the present invention and the target polypeptide in the sample. To this end, the antibody of the present invention is labeled to directly detect the reaction of interest. Alternatively, a labeled secondary antibody is used to indirectly detect the reaction. In the method of detection according to the present invention, the latter indirect detection technique (e.g., the sandwich technique) is preferably employed from the viewpoint of sensitivity.

Examples of label substances that can be used for enzyme immunoassay include enzymes such as peroxidase (POD), alkaline phosphatase, β-galactosidase, urease, catalase, glucose oxidase, lactate dehydrogenase, amylase, and a biotin-avidin complex. Examples of label substances that can be used for fluorescence immunoassay include fluorescent substances such as fluorescein isothiocyanate, tetramethylrhodamine isothiocyanate, substituted rhodamine isothiocyanate, dichlorotriazine isothiocyanate, Alexa, or AlexaFluoro and fluorophores. Examples of label substances that can be used for radio immunoassay include radioactive isotopes, such as tritium, iodine ($^{131}I$, $^{125}I$, $^{123}I$, and $^{121}I$), phosphorus ($^{32}P$), sulfur ($^{35}S$), and metals (e.g., $^{68}Ga$, $^{67}Ga$, $^{68}Ge$, $^{54}Mn$, $^{99}Mo$, $^{99}Tc$, and $^{133}Xe$). Examples of label substances that can be used for luminescent immunoassay include luminescent molecules such as an NADH-, FMNH2-, luciferase, luminol-hydrogen peroxide-POD, acridinium ester, or dioxetane compound, a luminescent substance, and bioluminescent substance.

Also, an avidin-biotin system or streptavidin-biotin system may be used optionally. In such a case, the antibody or fragment thereof of the invention may be bound, for example, to biotin.

A label can be bound to the antibody in case of enzyme immunoassay, for example, via the glutaraldehyde method, the maleimide method, the pyridyl sulfide method, or the periodic acid method. Radio immunoassay can be carried out in accordance with a conventional technique, such as the chloramine-T method or Bolton-Hunter method. Such assay techniques can be carried out in accordance with conventional techniques (Current protocols in Protein Sciences, 1995, John Wiley & Sons Inc., Current protocols in Immunology, 2001, John Wiley & Sons Inc.). When the antibody of the present invention is directly labeled, for example, a component in the sample is immobilized and brought into contact with the labeled antibody of the present invention to form a complex of the marker polypeptide and the antibody of the present invention. The unbound labeled antibody is separated by washing, and the amount of the target polypeptide in the sample can be determined based on the amount of the bound labeled antibody or the unbound labeled antibody.

When the labeled secondary antibody is used, for example, the antibody of the present invention is allowed to react with the sample (the primary reaction), then with the labeled secondary antibody (the secondary reaction). The primary reaction and the secondary reaction may be carried out in the reverse order, concurrently, or separately. The primary and secondary reactions result in the formation of a complex of immobilized target polypeptide/the antibody of the invention/labeled secondary antibody or a complex of the immobilized antibody of the invention/target polypeptide/labeled secondary antibody. The unbound labeled secondary antibody is separated by washing, and the amount of target polypeptide in the sample can be determined based on the amount of the bound labeled secondary antibody or of the unbound labeled secondary antibody.

In the enzyme immunoassay, specifically, the enzyme label is allowed to react with a substrate under optimal conditions, and the amount of the reaction product is assayed by an optical method or the like. In the fluorescence immunoassay, the fluorescent intensity from a fluorescent label is assayed. In the radio immunoassay, the radioactivity from radioactive label is assayed. In the luminescent immunoassay, the luminescent level from a luminescent reaction system is assayed.

In the method of the present invention, the generation of immune-complex aggregates in immunonephelometry, latex agglutination assay, latex turbidimetry, hemagglutination, particle agglutination, or the like is assayed by optically measuring the transmitted beam or scattered beam. When visually assayed, a solvent, such as a phosphate, glycine, Tris, or Good's buffer, can be used. Further, a reaction accelerator like polyethylene glycol or an inhibitor of nonspecific reaction may be added to the reaction system.

The above-mentioned antibody or a fragment thereof includes, for example, a polyclonal antibody, a monoclonal antibody, a synthetic antibody, a recombinant antibody, a polyspecific antibody (including a bispecific antibody), a single chain antibody, an Fab fragment, and an $F(ab')_2$ fragment. The polyclonal antibody can be prepared as a specific antibody by a so-called absorption method, which comprises binding the antibody to an affinity column to which a purified polypeptide has been bound.

The measurement can comprise the steps of: bringing an antibody labeled with a common enzyme or fluorophore or a fragment thereof into contact with a tissue section or homogenized tissue; and qualitatively or quantitatively measuring an antigen-antibody complex. Detection is carried out by, for example, a method wherein the presence and level of a target polypeptide are measured by immunoelectron microscopy, or a method wherein the level of a target polypeptide is assayed by a conventional method, such as ELISA or a fluorescent antibody method. Where the expression level of a target polypeptide is increased or decreased in the esophageal cancer tissue of a patient with metastasis as compared with the esophageal cancer tissue of a patient without metastasis, or where the blood level of a target polypeptide is significantly increased or decreased in the esophageal cancer tissue of a patient with metastasis as compared with the esophageal cancer tissue of a patient without metastasis, the subject is determined to have the metastasis of esophageal cancer. In other words, where the expression level or amount of the existing target polypeptide is significantly increased or decreased as compared with that of the patient without metastasis, the subject is determined to have the metastasis of esophageal cancer. Alternatively, where the expression level of a target polypeptide measured by the above described method is decreased in esophageal cancer tissue as compared with that in non-cancerous tissue, or wherein the blood level of a target polypeptide is significantly decreased in a patient with the esophageal cancer as compared with that in a healthy parson, the subject is determined to have esophageal cancer. That is, where the expression level or amount of the polypeptide is significantly decreased from the normal level, the subject is determined to have esophageal cancer. The term "significantly" as used herein means that the determined values are statistically significant.

The present invention will be described in more detail with reference to the examples set forth below; however, it is contemplated that the technical scope of the present invention is not limited to the examples.

EXAMPLES

Example 1

1. Clinical and Pathological Findings Concerning Subjects

Informed consent was obtained from 119 patients with esophageal cancer, and the esophagus tissues were excised from them at the time of the surgical excision of esophageal cancer or the esophageal biopsy. Part of the excised tissue was visually and/or histopathologically inspected to identify the esophageal cancer tissue, the esophageal cancer lesions were separated from the normal tissue, both of which were immediately freezed and stored in liquid nitrogen. Separately, the regional lymph nodes in the vicinity were removed from the excised tissue in order to pathologically diagnose the presence or absence of the metastasis of esophageal cancer cells.

2. Extraction of Total RNA and Preparation of cDNA

The tissue in the esophageal cancer lesion of the esophageal tissue obtained from an esophageal cancer patient was used as a sample. Total RNA was prepared from the tissue using a Trizol reagent (Invitrogen) in accordance with the manufacturer's recommended protocol.

The thus obtained total RNA (1 μg) was subjected to reverse transcription using oligo (dT) primers in combination with random nonamers and using the CyScribe First-Strand cDNA Labeling Kit (GE Healthcare) in accordance with the manufacturer's recommended protocols. Cy3-dUTP (GE Healthcare) was added to total RNA obtained from the esophageal cancer tissue, Cy5-dUTP (GE Healthcare) was added to reference total RNA (Stratagene), and cDNA was labeled at the time of reverse transcription in accordance with the manufacturer's recommended protocols. The labeled cDNA was purified using the QIA quick PCR purification Kit (QIAGEN) and then subjected to hybridization.

3. Preparation of Oligo DNA Microarray

As the oligo DNA microarrays, the GeneChip® (Human Genome U133 A, Affymetrix) and the DNA chip prepared by the method as described herein were used.

A method for preparing a DNA chip is described below. In order to determine the type of oligo DNA to be loaded at first, genes were identified using the GeneChip® (Affymetrix). The GeneChip® was operated in accordance with the protocol of the Complete GeneChip® Instrument System. As a result of the analysis using the Complete GeneChip®, total 8,961 types of genes, i.e., the genes whose expression patterns may vary due to esophageal cancer and the control genes, were extracted.

Sequences comprising 60-70 residues at sites having high sequence specificity of the extracted 8,961 types of genes were selected and synthesized while avoiding sequence overlapping. The 8,961 types of 60 or 70-mer synthetic oligo DNAs comprising oligo DNAs as shown in SEQ ID NOS: 21 to 40 were separately dissolved in 4× Solution I (Takara Bio) to a concentration of 30 μM. The resulting solutions were spotted on a DMSO-resistant coat glass for Matsunami DNA microarrays (an amino-modified oligo DNA-immobilized coat, type I; Matsunami Glass, Japan) using a spotter (GMS417 arrayer, Affymetrix) under a humidity environment of 50% to 60%.

4. Hybridization

The labeled cDNA (1 μg) was dissolved in an antisense oligo cocktail (QIAGEN), the resulting solution was applied to the DNA chip covered by a Gap cover glass (Matsunami Glass.), and hybridization was then carried out at 42° C. for 16 hours. After hybridization, the DNA chip was washed successively with 2×SSC/0.1% SDS, 1×SSC, and 0.2×SSC.

5. Assay of Gene Expression Level

The DNA chip that had been subjected to hybridization in the above-described manner was scanned using the Agilent microarray scanner (Agilent) to obtain an image, and the fluorescent intensity was expressed numerically. The statistic procedures were carried out with reference to Speed, T., "Statistical analysis of gene expression microarray data," Chapman & Hall/CRC, and Causton, H. C. et al., "A beginner's guide Microarray gene expression data analysis," Blackwell publishing. Specifically, the data obtained by the image analysis following hybridization were converted into log values, which were then normalized by global normalization and were smoothed by LOWESS (locally weighted scatterplot smoother), and normalization correction was carried out by MAD scaling. Consequently, the genes whose expression levels in the metastatic esophageal cancer lesions were higher or lower than those in the nonmetastatic esophageal cancer lesions, were identified. These genes are considered to be usable as genes for detecting the metastasis of esophageal cancer.

6. Prediction Scoring System

Specimens obtained from 50 patients were used as training samples to prepare a discriminant using SVM loaded on the Genomic Profiler (Mitsui Knowledge Industry, Japan). All the normalized data concerning the 119 cases were predicted using this discriminant. A linear Kernel was employed as Kernel. Genes were selected based on the p values of the t-test of two groups: i.e., one group of the metastatic esophageal cancer lesion and the other group of nonmetastatic esophageal cancer lesion.

All the specimens were subjected to analysis, a list of p values in ascending order (i.e., from smaller to larger values) as a result of the comparison between the metastatic esophageal cancer lesion and the nonmetastatic esophageal cancer lesion (i.e., the expression levels of the gene transcription products in the metastatic esophageal cancer lesion and in the nonmetastatic esophageal cancer lesion, and statistical values thereof) was obtained, and the top 47 types of genes were selected from the list (Table 2).

TABLE 2

| SEQ ID NO. | RefSeq No. | Gene name |
|---|---|---|
| 1 | NM_021913 | AXL |
| 2 | NM_014354 | C6orf54 |
| 3 | NM_014415 | ZBTB11 |
| 4 | NM_003820 | TNFRSF14 |
| 5 | NM_018044 | NSUN5 |
| 6 | NM_015001 | SPEN |
| 7 | NM_021070 | LTBP3 |
| 8 | NM_004711 | SYNGR1 |
| 9 | NM_004311 | ARL3 |
| 10 | NM_022444 | SLC13A1 |
| 11 | NM_006266 | RALGDS |
| 12 | NM_019903 | ADD3 |
| 13 | NM_006301 | MAP3K12 |
| 14 | NM_021732 | AVPI1 |
| 15 | NM_024711 | GIMAP6 |
| 16 | NM_018370 | FLJ11259 |
| 17 | NM_004054 | C3AR1 |
| 18 | NM_007144 | PCGF2 |
| 19 | NM_002601 | PDE6D |
| 20 | NM_002661 | PLCG2 |
| 21 | NM_207364 | GPR148 |
| 22 | NM_001663 | ARF6 |
| 23 | NM_007184 | NISCH |
| 24 | NM_005838 | GLYAT |
| 25 | NG_001019 | IGHM |
| 26 | NM_205836 | FBXO38 |
| 27 | NM_000338 | SLC12A1 |
| 28 | NM_014485 | PGDS |
| 29 | NM_001778 | CD48 |
| 30 | NM_014214 | IMPA2 |
| 31 | NM_002155 | HSPA6 |
| 32 | NM_003751 | EIF3S9 |
| 33 | NM_024697 | ZNF659 |
| 34 | NM_032144 | RAB6C |
| 35 | NM_006170 | NOL1 |
| 36 | NM_001343 | DAB2 |
| 37 | NM_005755 | EBI3 |
| 38 | NM_002771 | PRSS3 |
| 39 | NM_000404 | GLB1 |
| 40 | NM_022136 | SAMSN1 |
| 41 | NM_004925 | AQP3 |
| 42 | NM_006136 | CAPZA2 |
| 43 | NM_003780 | B4GALT2 |
| 44 | NM_019555 | ARHGEF3 |
| 45 | AB040946 | POGK |
| 46 | NM_022490 | PRAF1 |
| 47 | NM_000860 | HPGD |

SVM-based discriminating machines for identifying the esophageal cancer tissue were prepared for the selected 47 genes, and the polynucleotides as shown in SEQ ID NOS: 48 to 94 were used as probes to examine the gene expression. From the obtained data, a discriminant for the metastatic esophageal cancer lesion and for the nonmetastatic esophageal cancer lesion was prepared. As a result, the probability was found to vary depending on the number of genes used, and the metastatic esophageal cancer lesion was distinguished from the nonmetastatic esophageal cancer lesion at the probability of 86% or higher (FIG. 1).

Example 2

1. Clinical and Pathological Findings Concerning Subjects

Informed consent was obtained from 119 patients with esophageal cancer, and the esophagus tissues were excised from them at the time of the surgical excision of esophageal cancer or the esophageal biopsy. Part of the excised tissue slices was visually and/or histopathologically inspected to identify the esophageal cancer tissue, the esophageal cancer lesions were separated from the normal tissue, both of which were immediately freezed and stored in liquid nitrogen.

2. Extraction of Total RNA and Preparation of cDNA

The tissue in the esophageal cancer lesion of the esophageal tissue and the non-cancerous tissue (normal tissue) in the same esophageal tissue, which tissues had been obtained from a patient with esophageal cancer, were used as samples. Total RNA was prepared from the tissues using a Trizol reagent (Invitrogen) in accordance with the manufacturer's recommended protocol.

The thus obtained total RNA (1 μg) was subjected to reverse transcription using oligo (dT) primers in combination with random nonamers and using the CyScribe First-Strand cDNA Labeling Kit (GE Healthcare) in accordance with the manufacturer's recommended protocols. Cy3-dUTP (GE Healthcare) was added to total RNA obtained from the normal tissue or the esophageal cancer tissue, Cy5-dUTP (GE Healthcare) was added to reference total RNA (Stratagene), and cDNA was labeled at the time of reverse transcription in accordance with the manufacturer's recommended protocols. The labeled cDNA was purified using the QIA quick PCR purification Kit (QIAGEN) and then subjected to hybridization.

3. Preparation of Oligo DNA Microarray

As the oligo DNA microarrays, the GeneChip® (Human Genome U133 A, Affymetrix) and the DNA chip prepared by the method as described herein were used.

A method for preparing a DNA chip is described below. In order to determine the type of oligo DNA to be loaded at first, genes were identified using the GeneChip® (Affymetrix). The GeneChip® was operated in accordance with the protocol of the Complete GeneChip® Instrument System. As a result of the analysis using the Complete GeneChip®, total 8,961 types of genes, i.e., the genes whose expression patterns may vary due to esophageal cancer and the control genes, were extracted.

Sequences comprising 60-70 residues at sites having high sequence specificity of the extracted 8,961 types of genes were selected and synthesized while avoiding sequence overlapping. The 8,961 types of 60 or 70-mer synthetic oligo DNAs comprising oligo DNAs as shown in any of SEQ ID NOS: 162 to 181 were dissolved in 4× Solution I (Takara Bio) to a concentration of 30 μM. The resulting solutions were spotted on a DMSO-resistant coat glass for Matsunami DNA microarrays (an amino-modified oligo DNA-immobilized coat, type I, Matsunami Glass Ind., Ltd.) using a spotter (GMS417 arrayer, Affymetrix) under a humidity environment of 50% to 60%.

4. Hybridization

The labeled cDNA (1 μg) was dissolved in an antisense oligo cocktail (QIAGEN), the resulting solution was applied to the DNA chip covered by a Gap cover glass (Matsunami Glass), and hybridization was then carried out at 42° C. for 16 hours. After hybridization, the DNA chip was washed successively with 2×SSC/0.1% SDS, 1×SSC, and 0.2×SSC.

5. Assay of Gene Expression Level

Figure 2:
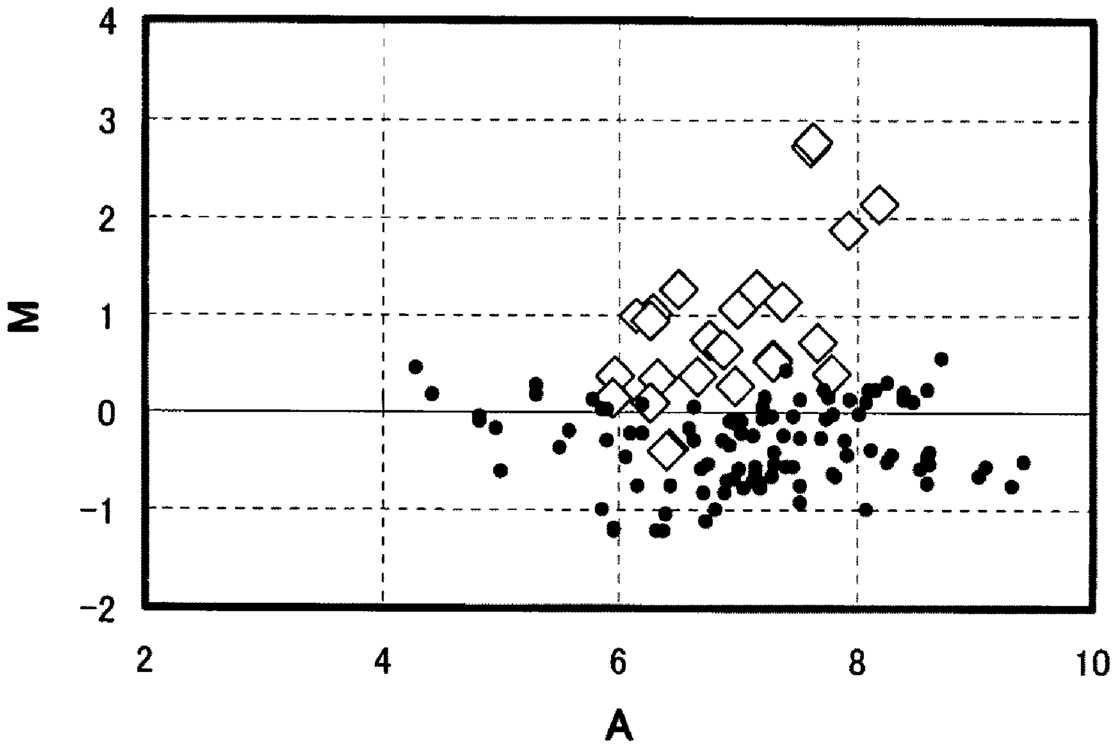
FIG. 2 shows the correlation between the expression level and the expression intensity with respect to the genes expressed in non-cancerous tissue (M-A plot, white rhombus: esophageal cancer-detecting gene; black circle: control gene). M shown on the vertical axis, i.e. Minus, represents a difference in log value of the determined value between control sample and the analyte sample for each gene; and A shown on the horizontal axis, i.e. Add, represents the sum of log values of the determined values.
Figure 3:
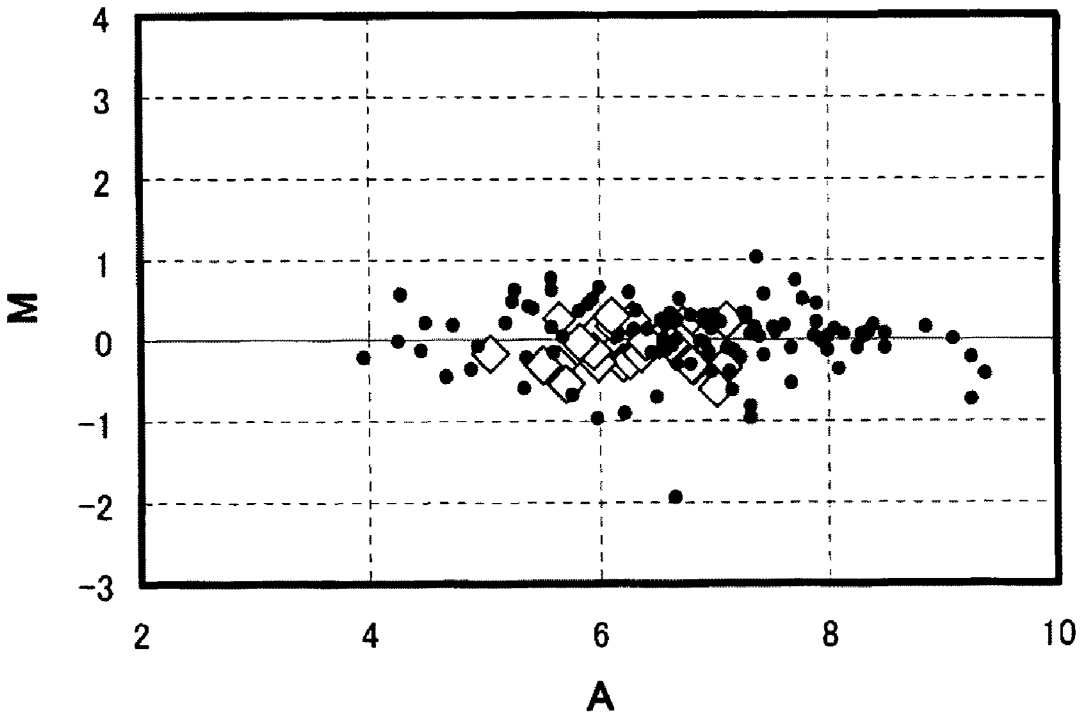
FIG. 3 shows the correlation between the expression level and the expression intensity with respect to the genes expressed in an esophageal cancer tissue (M-A plot, white rhombus: esophageal cancer-detecting gene; black circle: control gene). M shown on the vertical axis, i.e., Minus, represents a difference in log value of the determined value between control sample and the analyte sample for each gene, and A shown on the horizontal axis, i.e., Add, shows the sum of the determined log values.

The DNA chip that had been subjected to hybridization in the above-described manner was scanned using the Agilent microarray scanner (Agilent) to obtain an image, and the fluorescent intensity was expressed numerically. The statistic procedures were carried out with reference to Speed, T., "Statistical analysis of gene expression microarray data," Chapman & Hall/CRC, and Causton, H. C. et al., "A beginner's guide Microarray gene expression data analysis," Blackwell publishing. Specifically, the data obtained by the image analysis following hybridization were converted into log values, which were then smoothed by global normalization and LOWESS (locally weighted scatterplot smoother), and normalization correction was carried out by MAD scaling. Consequently, the M-A plots as shown in the non-cancerous tissue (FIG. 2) and in the esophageal cancer lesion (FIG. 3) were obtained. As a result, the genes whose expression levels in the esophageal cancer lesions were lower than those in the non-cancerous tissue, were identified. These genes are considered to be usable as genes for detecting esophageal cancer.

6. Prediction Scoring System

Specimens obtained from 50 patient were used as training samples to prepare a discriminant using SVM loaded on the Genomic Profiler (Mitsui Knowledge Industry, Japan). All the normalized data concerning the 119 cases were predicted using this discriminant. A linear Kernel was employed as Kernel. Genes were selected based on the p values of the t-test of two groups: i.e., one group of the esophageal cancer lesion and the other group of the normal tissue.

All the specimens were subjected to analysis, a list of p values in ascending order (i.e., from smaller to larger values) as a result of the comparison between the esophageal cancer lesion and the non-cancerous tissue (i.e., the expression levels of the gene transcription products in the esophageal cancer lesion and in the non-cancerous tissue and the statistical values thereof) was obtained, and the top 20 genes were selected from the list (Table 3).

TABLE 3

| SEQ ID NO. | RefSeq No. | Gene Name | Average expression in esophageal cancer tissues | Average expression in non-cancerous tissues | Expression ratio | p value |
|---|---|---|---|---|---|---|
| 142 | NM_000512 | GALNS | 0.0973 | 1.4314 | 0.0680 | 1.202E−28 |
| 143 | NM_005247 | fgf3 | 0.5985 | 1.6205 | 0.3693 | 5.559E−26 |
| 144 | NM_001220 | CAMK2B | 0.4458 | 1.5041 | 0.2964 | 3.325E−25 |
| 145 | NM_018584 | CaMKIINalpha | 0.5047 | 1.4250 | 0.3542 | 3.057E−23 |
| 146 | NM_018622 | PSARL | 0.4463 | 1.3263 | 0.3365 | 3.410E−23 |
| 147 | NM_005432 | XRCC3 | 0.2565 | 1.5277 | 0.1679 | 2.539E−22 |
| 148 | NM_001747 | CAPG | −0.0551 | 0.5347 | −0.1030 | 9.067E−22 |
| 149 | NM_012203 | GRHPR | 0.2030 | 0.6696 | 0.3032 | 2.052E−21 |
| 150 | NM_005480 | TROAP | 0.1192 | 0.8631 | 0.1381 | 2.679E−20 |
| 151 | NM_001034 | RRM2 | 0.2014 | 1.3656 | 0.1475 | 5.005E−20 |
| 152 | NM_145799 | SATB2 | −0.0286 | 0.7859 | −0.0364 | 3.150E−20 |
| 153 | NM_020181 | C14orf162 | 0.0208 | 0.6663 | 0.0312 | 8.849E−20 |
| 154 | NM_015129 | SEPT6 | 0.9592 | 1.9645 | 0.4883 | 7.463E−17 |
| 155 | NM_002355 | M6PR | 0.0827 | 1.2163 | 0.0680 | 5.031E−17 |
| 156 | NM_005416 | SPRR3 | 0.9948 | 3.3983 | 0.2927 | 2.245E−21 |
| 157 | NM_004434 | EML1 | 0.3842 | 0.9892 | 0.3884 | 3.975E−20 |
| 158 | NM_016061 | YPEL5 | 0.5802 | 1.3857 | 0.4187 | 1.490E−19 |
| 159 | NM_004096 | EIF4EBP2 | 0.0722 | 0.6894 | 0.1047 | 2.750E−19 |
| 160 | BC060766 | SLC2A14 | 0.2201 | 1.1413 | 0.1929 | 4.134E−19 |
| 161 | NM_004787 | SLIT2 | 0.4612 | 1.0326 | 0.4466 | 2.331E−19 |

SVM-based discriminating machines for identifying the esophageal cancer tissue were prepared for the selected 20 types of genes (indicated by white rhomboids in FIG. 2 and FIG. 3), and the polynucleotides as shown in SEQ ID NOS: 162 to 181 were used as probes to examine the gene expression. From the obtained data, a discriminant for the esophageal cancer tissue and for the non-cancerous tissue was prepared. As a result, the probability was found to vary depending on the number of genes used, and the esophageal cancer lesion was distinguished from the non-cancerous tissue at the probability of 89% or higher (FIG. 4).

Esophageal cancer lesions obtained from surgically excised pieces and biopsy samples and non-cancerous tissues obtained from only surgically excised pieces, were used as training specimens to perform analysis. The genes were selected in ascending order (i.e., from smaller to larger values) of p values concerning the differences in expression levels between the esophageal cancer lesion and the non-cancerous tissue, and SVM-based discriminating machines for identifying non-cancerous tissue were prepared. As an optimal probe combination, the polynucleotides as shown in SEQ ID NOS: 162 to 165, 167, 171, 173, 174, and 176 were used to evaluate the gene expression. As a result, the non-cancerous tissue was identified at the probability of 93%.

Esophageal cancer lesions obtained from surgically excised pieces and non-cancerous tissue obtained from only the surgically excised pieces and biopsy samples were used as training specimens to perform analysis. The genes were selected in ascending order (i.e., from smaller to larger values) of p values concerning the differences in the expression levels between the esophageal cancer lesion and the non-cancerous tissue, and SVM-based discriminating machines for identifying esophageal cancer tissue were prepared. As an optimal probe combination, the polynucleotides as shown in SEQ ID NOS: 162 to 166, 168 to 172, and 175 were used to evaluate the gene expression. As a result, the esophageal cancer tissue was identified at the probability of 96%.

The SVM that identifies the non-cancerous tissue and the SVM that identifies the esophageal cancer lesion were simultaneously applied to the gene expression levels of an analyte tissue, and the analysis was thus performed.

When the two discriminants simultaneously yielded the result that the analyte tissue was a non-cancerous tissue or when the two discriminants yielded the result that the analyte was an esophageal cancer lesion, the accuracy of each diagnosis was found to be significantly higher than the accuracy attained by conventional diagnostic methods comprising the use of a single discriminant.

Example 3

1. Detection by RT-PCR

The tissue of the esophageal cancer lesion in the esophageal tissue and the non-cancerous tissue (normal tissue) of the same esophageal tissue, which tissues were obtained from patients with esophageal cancer, were used as samples. Total RNA was prepared from the above tissues using a Trizol reagent (Invitrogen) in accordance with the manufacturer's recommended protocol. cDNA was synthesized from total RNA using the SuperScript III® First Strand SuperMix, and the cDNA corresponding to 20 ng total RNA was subjected to amplification using TaKaRa Taq® (Takara Bio, Kyoto, Japan). In order to detect the CaMKIINalpha and YPEL5 genes belonging to the group II above, primers (Takara Bio) each consisting of 20 nucleotides corresponding to the gene sequences (SEQ ID NOS: 145 and 158) were subjected to amplification. The composition of the reaction solution was determined in accordance with the provided protocol. The reaction was carried out by the treatment at 95° C. for 1 minute, and a cycle of 95° C. for 15 seconds, 55° C. for 30 seconds, and 72° for 30 seconds was then repeated 23 (GAPDH) to 26 (CaMKIINalpha and YPEL5) cycles, followed by the treatment at 72° C. for 7 minutes. The reaction mixture after the reaction was electrophoresed on 2% agarose gel, and the expression of each gene was confirmed (FIG. 5).

Figure 5:
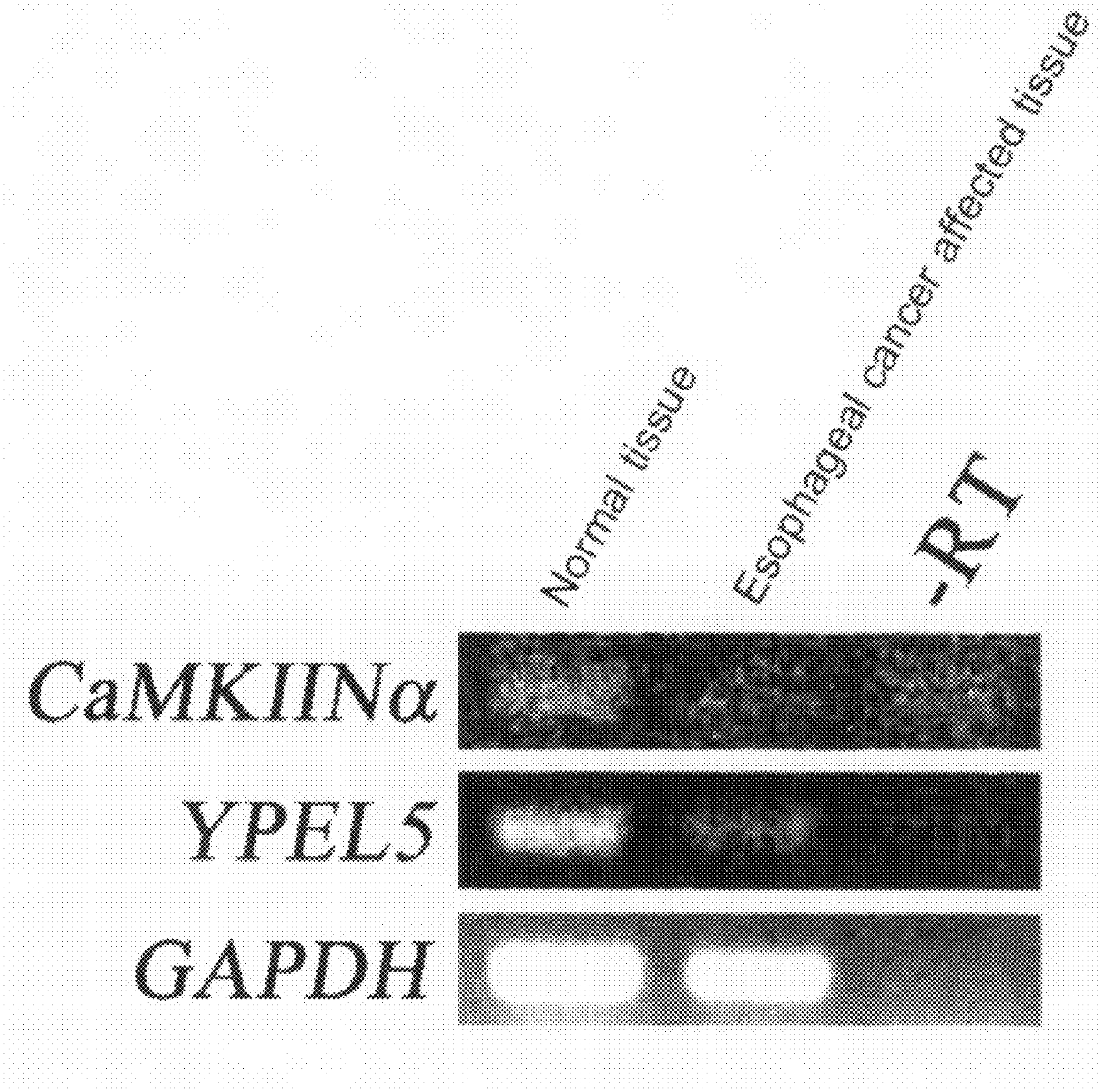
FIG. 5 shows the decrease in expression levels of the CAMKIIalpha and the YPEL5 genes in esophageal cancer affected tissue, detected by RT-PCR, wherein GAPDH indicates a constantly-expressed gene, i.e., glyceraldehyde-3-phosphate dehydrogenase; and -RT indicates a reaction without Taq polymerase.

As is apparent from FIG. 5, the expression levels of the CaMKIINalpha and YPEL5 genes were decreased in the tissue of the esophageal cancer lesion than in the normal tissue.

2. Detection by Quantitative RT-PCR cDNA prepared in the same manner as in the case of the "1. Detection by RT-PCR" above was used as a sample. Quantitative RT-PCR was carried out in accordance with the information provided on the website of Takara Bio (Kyoto, Japan) (available on the internet). In fluorescent detection, SYBR premix ExTaq (Takara Bio) and ABI PRISM 7000 were used, the composition of the reaction solution was determined in accordance with the protocol of SYBR premix ExTaq, and the reaction was carried out via 45 cycles of amplification in accordance with the protocol of ABI PRISM 7000. In order to detect the CaMKIINalpha gene (SEQ ID NO: 145) and the GAPDH gene, primers (Takara Bio) of 20 nucleotides corresponding to the gene sequences were used for amplification. In order to prepare a calibration curve for quantitative PCR, a PCR fragment prepared from esophageal tissue was diluted to a given concentration and used for the CaMKIINalpha gene, and cDNA synthesized from human reference RNA (Stratagene) was diluted to a given concentration and used for a constantly expressed gene, GAPDH (the term "constantly expressed gene" as used herein refers to a gene whose expression level is substantially constant in most human cells or tissues, the gene being called "house-keeping gene"), cDNAs of CaMKIINalpha and of GAPDH corresponding to 10 ng total RNA were subjected to quantitative PCR for each tissue, and the ratio of CaMKIINalpha expression level to GAPDH expression level was calculated.

As a result, the CaMKIINalpha/GAPDH expression ratio in the esophageal cancer lesion tissues of the esophageal tissues from patients with esophageal cancer was found to be 0.41, while that of the normal tissue was found to be 3.16. This indicates that the CaMKIINalpha expression level is reduced in the esophageal cancer lesion.

3. Results

The expression levels of the CaMKIINalpha and YPEL5 mRNA in the esophageal cancer tissue were examined by RT-PCR. As a result, their expression levels in the esophageal cancer tissue tended to decrease as compared with those in the normal esophageal tissue.

Further, the quantitative RT-PCR demonstrated that the expression level of CaMKIINalpha mRNA in the esophageal cancer tissue was decreased to about 1/7.7 of that in normal esophageal tissue.

4. Semiquantitative RT-PCR

Semiquantitative RT-PCR was carried out using the LightCycler (Roche Diagnostics). The tissue of the esophageal cancer lesion in the esophageal tissue and the non-cancerous tissue (or normal tissue) in the same esophageal tissue, which tissues were obtained from a patient with esophageal cancer, were used as samples. Total RNA was extracted from the above tissues, and cDNA was synthesized therefrom using the first strand synthesis kit (GE Healthcare). The primers for XRCC3 and RRM2 of group II and GAPDH as an endogenous control were: 5'-ACTGTGCCCCACAAAACTTC-3' (SEQ ID NO: 234) and 5'-GACCCTCCTTCCTCTCAACC-3' (SEQ ID NO: 235) for XRCC3; 5'-GGCTGGCTGTGACTTACCAT-3' (SEQ ID NO: 236) and 5'-AATCTGCGTTGAAGCAGTGA-3' (SEQ ID NO: 237) for RRM2; and 5'-TGGTATCGTGGAAGGACTCATGC-3' (SEQ ID NO: 238) and 5'-ATGCCAGTGAGCTTCCCGTTCAGC-3' (SEQ ID NO: 239) for GAPDH, the sequences of which were determined using the primer3 (available on the internet). Concerning the obtained cDNA template (2 μl), 50 pmol each of primers and 2.4 μl of 3 mM $MgCl_2$ were mixed with 2 μl of the LightCycler DNA MASTER SYBR GreenI, 10× cone (Roche Diagnostics), and PCR was carried out using the LightCycler. The reaction was carried out by treating the reaction solution at 95° C., and a cycle of 94° C. for 1 second, an annealing temperature of 58° C. (XRCC3) or 53.1° C. (RRM2) for 5 seconds, and 72° C. for 18 seconds was repeated 45 cycles, followed by heating up to 95° C. at a rate of 0.2° C./sec, to examine the melting curve. In all the experiments, the samples were diluted to prepare a quantitative curve for the GAPDH expression level, and the RRM2 and XRCC3 expression levels in the tissue of the esophageal cancer lesion and in the normal tissue were semiquantified.

As a result, the expression level of RRM2 was found to be decreased to 1:0.06 in terms of the ratio of normal tissue to esophageal cancer lesion, and that of XRCC3 was found to be decreased to 1:0.11.

Example 4

1. Identification of Blood Plasma Proteins in Healthy Persons and Patients with Esophageal Cancer EDTA-added blood plasma components were obtained from 11 patients with esophageal cancer at an age of 50s to 70s, and from 8 healthy persons at the corresponding age. Pools of blood plasma from 4 healthy persons were prepared at random and subjected to the analysis. The blood plasmas from the esophageal cancer bearing patients were independently analyzed.

The blood plasma was filtered through a filter (pore size 0.22 μm) to remove contaminants, and the protein concentration was adjusted to 50 mg/ml. The resulting blood plasma was further diluted in 25 mM ammonium bicarbonate solution (pH 8.0) to the concentration of 12.5 mg/ml, and molecular weight fractionation was then carried out using a hollow fiber filter (Toray, Japan). The fractionated blood plasma sample (total amount 1.8 ml, comprising 250 μg (max) of proteins) was divided into 7 fractions by reversed-phase chromatography (the ProteomeLab® PF2D System (Beckman Coulter)), lyophilized, and then redissolved in 100 µl of the 25 mM ammonium bicarbonate solution (pH 8.0). This sample was digested with trypsin (1/50 volumes of the protein) at 37° C. for 2 to 3 hours for peptidization. Each peptide fraction was further fractionated into 4 fractions on the ion-exchange column (KYA Technologies).

Each fraction was further fractionated on the reversed-phase column (KYA Technologies), the eluted peptides were measured using an online-linked mass spectrometer Q-TOF Ultima (Micromass) in a survey scan mode. The resulting data was analyzed using the protein identification software MASCOT (Matrix Science), to perform exhaustive identification of proteins. As a result, about 3,500 proteins, which exhibit a MASCOT score of 40 or higher (the number of identified peptides: two or more), were identified from the blood plasma components of healthy persons and of esophageal cancer bearing patients.

2. Comparison of the Expression of Blood Plasma Proteins in Healthy Persons and Patients with Esophageal Cancer The blood plasma proteins identified in section 1 above were compared between healthy persons and patients with esophageal cancer. Proteins that were not expressed in healthy persons but were expressed in patients with esophageal cancer, were discovered. These proteins were found to be the polypeptides as shown in SEQ ID NOS: 202 to 233 in Table 1, and were found to be useful as the so-called esophageal cancer markers, for detecting esophageal cancer. Table 4 shows a frequency of the expression in each of the patients. In two groups each consisting of 4 healthy persons, such expression was not detected (indicated by "−"). Among the 11 esophageal cancer bearing patients, however, such expression was detected in 10 patients (indicated by "+").

TABLE 4

| Protein | Group A of H.P. | Group B of H.P. | Pat 1 | Pat 2 | Pat 3 | Pat 4 | Pat 5 | Pat 6 | Pat 7 | Pat 8 | Pat 9 | Pat 10 | Pat 11 |
|---|---|---|---|---|---|---|---|---|---|---|---|---|---|
| SMARCA1 | − | − | + | + | + | + | + | + | + | + | + | + | + |
| ITGA1 | − | − | + | + | + | + | + | + | + | + | + | + | + |
| GM632 | − | − | + | + | + | + | + | + | + | + | + | + | + |
| RREB1 | − | − | + | + | + | + | + | + | + | + | + | + | + |
| DHX37 | − | − | + | + | + | + | + | + | + | + | + | + | + |
| IGLC2 | − | − | + | + | + | + | + | + | + | + | + | + | + |
| TBC1D8 | − | − | + | + | + | + | + | + | + | + | + | + | + |
| ATP8B2 | − | − | + | + | + | + | + | + | + | + | + | + | + |
| PYGL | − | − | + | + | + | + | + | + | + | + | + | + | + |
| CDKL5 | − | − | + | + | + | + | + | + | + | + | − | + | + |
| SNX2 | − | − | + | + | + | + | + | + | + | + | − | + | + |
| TTC7A | − | − | + | + | + | + | + | + | + | + | + | + | − |
| ADSL | − | − | + | + | + | + | + | + | + | − | + | + | + |
| USP19 | − | − | + | + | + | + | + | + | + | + | − | + | + |
| BUB1 | − | − | + | + | + | + | + | + | + | + | − | + | + |
| ABCC4 | − | − | + | + | + | + | + | + | + | + | + | + | − |
| GNPAT | − | − | + | + | + | + | + | + | + | + | + | − | + |
| MYBPC2 | − | − | + | + | + | + | + | + | + | − | + | + | + |
| BMP2K | − | − | + | + | + | + | + | + | + | + | − | + | + |
| OXCT1 | − | − | + | + | + | + | + | + | + | + | + | + | − |
| ITGA9 | − | − | + | + | + | + | + | + | + | + | + | − | + |
| SPATA7 | − | − | + | + | + | + | + | + | + | + | − | + | + |
| ZNF624 | − | − | + | + | + | + | + | + | + | + | + | + | − |
| USP20 | − | − | + | + | + | + | + | + | + | + | + | + | − |
| ACAD8 | − | − | + | − | + | + | + | + | + | + | + | + | + |
| APLP2 | − | − | + | − | + | + | + | + | + | + | + | + | + |
| HNRPR | − | − | + | + | + | + | + | + | + | + | − | + | + |
| CD59 | − | − | − | + | + | + | + | + | + | + | + | + | + |
| DDX18 | − | − | − | + | + | + | + | + | + | + | + | + | + |
| SEC63 | − | − | − | + | + | + | + | + | + | + | + | + | + |
| TMEM16C | − | − | − | + | + | + | + | + | + | + | + | + | + |
| TEKT2 | − | − | − | + | + | + | + | + | + | + | + | + | + |

1) H.P. indicates healthy persons.
2) Pat 1 to Pat 11 indicate patients 1 to 11 with esophageal cancer.

Thus, the esophageal cancer can be detected by measuring the presence or amount of at least one of the above-described polypeptides using, for example, antibodies specific thereto.

INDUSTRIAL APPLICABILITY

The present invention enables the detection, determination, or prediction of at least the esophageal cancer at phase I or the lymph node metastasis of esophageal cancer. Thus, the present invention provides the compositions for diagnosing esophageal cancer with excellent specificity and sensitivity, which will be particularly useful in the pharmaceutical and medical industries.

SEQUENCE LISTING FREE TEXT

SEQ ID NO: 234; description of artificial sequence: primer
SEQ ID NO: 235; description of artificial sequence: primer
SEQ ID NO: 236; description of artificial sequence: primer
SEQ ID NO: 237; description of artificial sequence: primer
SEQ ID NO: 238; description of artificial sequence: primer
SEQ ID NO: 239; description of artificial sequence: primer

SEQUENCE LISTING (239 sequences)

SEQ ID NO: 1 - DNA, 5014 bp, Homo sapiens
gagtggagttctggaggaatgtttaccagacacagagcccagagggacagcgcccagagcccagatagagagacacggcctcactggctcagcaccagggtccccttccccctcctcagctccctccctggcccctttaagaaagagctgatcctctcctctcttgagttaacccctgattgtccaggtggcccctggctctggcctggtgggcggaggcaaagggggagccaggggcggagaaagggttgcccaagtctgggagtgagggaaggaggcaggggtgctgagaaggcggctgctgggcagagccggtggcaagggcctcccctgccgctgtgccaggcaggcagtgccaaatccggggagcctggagctggggggagggccggggacagcccggccctgccccctcccccgctgggagcccagcaacttctgaggaaagtttggcacccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagggcaagcacagccagtccaccagctggtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcctacttttttttttttttttttttttttttttttttttgcgatagagtctcactgtgtcacccaggctggagtgcagtggtgcaatctcgcctcactgcaaccttcacctaccgagttcaagtgattttcctgccttggcctcccaagtagctgggattacaggtgtgtgccaccacacccggctaatttttatatttttagtagagacagggtttcaccatgttggccaggctggtctaaaactcctgacctcaagtgatctgcccacctcagcctcccaaagtgctgagattacaggcatgagccactgcactcaaccttaagacctactgttctaaagctctgacattatgtggttttagattttctggttctaacatttttgataaagcctcaaggttttaggttctaaagttctaagattctgattttaggagctaaggctctatgagtctagatgtttattcttctagagttcagagtccttaaaatgtaagattatagattctaaagattctatagttctagacatggaggttctaaggcctaggattctaaaatgtgatgttctaaggctctgagagtctagattctctggctgtaaggctctagatcataaggcttcaaaatgttatcttctcaagttctaagattctaatgatgatcaattatagtttctgaggctttatgataatagattctcttgtataagatcctagatcctaagggtcgaaagctctagaatctgcaattcaaaagttccaagagtctaaagatggagtttctaaggtccggtgttctaagatgtgatattctaagacttactctaagatcttagattctctgtgtctaagattctagatcagatgctccaagattctagatgattaaataagattctaacggtctgttctgtttcaaggcactctagattccattggtccaagattccggatcctaagcatctaagttataagactctcacactcagttgtgactaactagacaccaaagttctaataatttctaatgttggacacctttaggttctttgctgcattctgcctctctaggaccatggttaagagtccaagaatccacatttctaaaatcttatagttctaggcactgtagttctaagactcaaatgttctaagtttctaagattctaaaggtccacaggtctagactattaggtgcaatttcaaggttctaaccctatactgtagtattctttggggtgcccctctccttcttagctatcattgcttcctcctccccaactgtgggggtgtgcccccttcaagcctgtgcaatgcattagggatgcctcctttcccgcaggggatggacgatctcccacctttcgggccatgttgcccccgtgagccaatccctcaccttctgagtacagagtgtggactctggtgcctccagaggggctcaggtcacataaaactttgtatatcaacgaaaaaaa

SEQ ID NO: 2 - DNA, 2800 bp, Homo sapiens
cgccaccaatgtggcccaggccaccagcccccgtgacactgcagccatcccctttgctccccgtcgtggcctcccgaccgagcagccagagtgaccccgaaagcctaaatcagcctgcggcgccctcacccgtcctccagctgccatcgcctcctgggtgaagaggacgcaggtcgcagcccccgcagctctgcccctctgccctccggccaggccgccccgctgtcccccttgctgtccacctctctgtccacccctgctgtccccccccgctgtcccccccgctgtcacacccccgctgtcccccccccgctgtcccccctgttgtccccccgctgtccctcccgctgtccctccggcgaggaggcttctgcacgttctgcgtgggcctctccccggggccgccccaggtctcccctgacgcccacacccaccaccaggctgttgtgcgggaccttccttctctgcctctccagctggtgacgcgcactgacgtcctgcaaggcccgctccaggtgcgccacctttgactggcatgctgaaaggacaaagggacggaggcattttaccggagaggacatccatggggcccagcaggtcaaattcctttctctaagtatgggagacatttttaaaaataatggagtcctccagggccggctgcgtgctgtggcctgtgctcctcaccgctttggacccaggctgcgctgtctccaccacgaccaaggactcacagagctcgcctgggggacctggccccacagtcaccccgtccgtcatcagcctcaaatgccatcagcccgtgaatgctgctccatcgtctgcatggcagccaaggaggtctctgctcctaaagcacctgggagcccttggatggtgccaggtgatgtggcgatgagtgggcatcgcgtgggggccttggacgagcgtggacaccccaatccccagactggccattgccgtggaggcagcgtgagtgtgacatggagctcggtgtcgtgctgcagaggacgcctcgcggctgtacgcgtcatgatagccagggacccctccacatgtcacttagccaaaggatgcagcccggcctggggctttctaccccaggcccgaggacctgcagggacaaggacccctcagcgcagatgcagctctcatgaggcctgaaaccaagctggacttgcagaactgcgcacgctccctttctgaaagaaacacccgttaccgggtccagactgaatgtgggcgtaagaaagcgggaagggtcccccacagcaagagagagagcctcccagtcacttggtcatctgagccttgagtgtgtccggccccagccaccagcctgtccccactatccctcttgtcagcacggctgaaaggagctgcctgggcacctgaggtggctgaggctcatctttgaggagcatggaactcgaggggagaagtcgcgcccccagggaagccaggaaactctgacacagaacgcccaacgtggacacaggtgccagttcagcagtgaccgtcaagaccggggaagtgccctgtggtgaccaggagaacaaggagctcctccagcaagcagggctgcagtgggagctgggagggagcagtgcacctgccagcgtggccgagtcacacagtgcctgccctcacctgtggaatttggtgtcagctaaaaggaagaagaaatggaaacttaaattctagccggtcattttcttaaaactgcaaacatttctctcgagtgtggactggcccggcttcggtgaaaggcgccctcctacctagcagggtctcggcactctgctgtgttctttgcaccgcggtcactatttcagaaacacggtcctgatactcatcctgataatctcttaagagcacccgagaagaagaatgaaacgcctgtatatcctggttaagtttctataaaataagaacatacacgattcataaaattatatgattaatgatcacagtataattacataagaatttgttatatatgtttctatagaataataacatacccacacaattaatataagggatatgttgttaactggaagggtgtaaagcagttcttcggcccgggcctgtcgatgcccgccaggactgttttcatgctgcctgtgcctcggctcacttacagaagttctgactcaatacatctgggatttctactttcaaagcagtacatgtgattttatgcccttaaagtatttaagaaacagaaagtcaagtgtttcaccaatttccgtaggaagggccgctcactgcacggtggggcgatgctgggcgcgagccgtgtttccgtctattgttgacttcctcacgatgctggctcaggctcagagcctctcatcaccgcctgtgaaatggggaccaccctcctaatctactatccagacctaccttctggaagctcaattatcacgagcacatggtggaaaacgtgggccggtgacaacttaacatgtaaatgtacataataaaattccaggcacaatacatatgaacgcttttagagaactttgggagcaaagcaactgatgtcctgcgtggaaagtcctcttctccccatgaaattatctcaaggatcttccatgggaagatgtgacagaaccaggacactactgcttaatatttaatatcagatactcttaaatcacaagagcataactaaagtattcttcgtttctttagtcaaatctccttttctataaaatggagacggctttcatatgtttgggaaacattttaataacgaattaataaacattttaatatcaaaaaaaaaaaaaaa

SEQ ID NO: 3 - DNA, 5052 bp, Homo sapiens
cggcgcttttccttcggactaagggagccgtcgaagagcgctcgccaaaggccagccgtttctccctacggtgccgccgctcctcctgcagccgcccgtaggtagcgggccgttttcctcacctgtccctgacaggcgccctcagggagccgcggtccgcgatgtcaagcgaggaaagctaccgggccatcctgcgttacctgacgaacgagcgcgagccgtatgcgccgggcaccgagggcaatgtcaagcgtaaaatccgaaaagctgccgcctgctacgtggtgcgcggcgggactctgtattaccagcggcggcagcggcaccgcaagaccttcgcggagctggaggtggtgctgcagccggagcgacgccgggacctcatcgaggcggcgcacctgggtcccggcggcactcaccacacccggcatcagacctggcactacttgtccaagacgtactggtggcgaggtatattgaagcaagtcaaagattacattaaacagtgtagcaaatgccaggagaaactagatcgatcccgtccaatatcagatgtttcagaaatgttggaagaattgggactagaccttgaatctggagaagaaagtaatgaatcggaagatgacctgagcaactttacttcatctccaactacagcatccaagcctgcaaaaaagaagccagtatccaaacatgaacttgtgtttgttgacaccaaaggagtggtaaaacgttcttctccaaaacattgtcaggctgtcttaaaacagctgaacgaacagagactttccaaccagttctgtgatgttactttgttaattgaaggagaagagtacaaagctcataaatctgttttgtcagcaaatagcgagtattttcgagatctttttattgagaaaggagctgtttccagtcatgaggctgtggtggatctttctggtttttgtaaggccagcttccttcctttactggaatttgcctatacttctgtactaagttttgatttctgtagcatggctgatgtagccatcttagctcgtcatcttttcatgtcagaagtcttagagatttgtgaaagtgtacataagctaatggaagagaagcagctaacagtatataagaagggcgaagtacaaacagttgcatccacccaggacttacgagtacagaatggaggtacagcacctcctgttgctagcagtgagggaaccacaacaagtttacctactgaacttggggattgtgaaattgtactactggtaaatggagaattgccagaagctgagcagaatggagaggtaggacgacagcctgagccccaggtttcttcagaggctgaatctgccctgtcatcagtaggatgtatagctgattcccatcctgaaatggagtctgttgatttaataacaaaaaacaaccagacagaactagaaacttcaaacaacagagaaaataacacagtttctaatatacaccctaaactttcaaaagagaatgtaattagtagctcgccagaggatagtggtatgggaaatgatatatcagctgaggatatttgtgccgaagacattccaaaacataggcagaaagttgaccaacctttaaaagatcaggaaaatctagttgcatcaacagcaaagacaaactttggccctgatgatgatacttatagaagcaggcttcgacaacgttctgttaatgaaggggcatatattcgactacacaagggaatggagaaaaagctgcagaaacggaaagccgttcccaagtcagcagttcaacaggtggctcagaagttagttcaaagaggaaaaaagatgaaacagccaaaaagagatgctaaagagaacacagaagaagcatctcataaatgtggggaatgtggaatggtttttcagagacgatacgcccttataatgcacaaactgaaacatgaaagagctagagattacaaatgtccattgtgtaaaaaacagtttcagtacagtgcctctttgcgagcacatcttattcgtcataccagaaaagatgcaccctcttcatcctcgtccaattccacgtctaatgaagcatcgggaacatcatctgagaagggcagaaccaagcgggaatttatatgttccatatgtggaagaacattacctaaattatattctctccgaatacatatgttaaagcacacaggtgtaaagccacatgcatgccaggtctgtggaaagacttttatctataagcatggtctaaaattacatcagagtcttcatcaatcacagaagcagttccagtgtgaactgtgtgttaagtcatttgttaccaaacggagtcttcaagaacatatgagtattcacacaggagagtccaagtacctttgctcagtttgtggaaagtcttttcataggggctctggactcagcaagcacttcaagaaacaccaaccaaagcctgaggttcgaggctatcattgtactcaatgtgaaaaaagtttctttgaagctagagatcttcgccagcacatgaacaaacatcttggtgtgaagccattccagtgccaattttgtgataagtgctatagttggaagaaagattggtattcccatgtgaagtctcattctgtcactgagccttataggtgtaatatatgtggcaaagaattttatgaaaaagctttgttcagaaggcatgtaaagaaagctacccatgggaagaaaggaagagcaaagcaaaacctggaacgggtgtgtgaaaaatgtggaagaaaattcactcagctaagagagtataggagacacatgaacaaccatgaaggagttaagccatttgagtgcttaacatgtggagtagcttgggctgatgcccgatctctaaaacgccatgtcagaacacatactggtgaacggccctatgtctgtcctgtatgtagcgaagcctacatagatgctcgaacactccgtaaacatatgactaaattccacagagactatgtgccttgcaaaattatgctggaaaaagacacccttcagtttcataaccaaggaactcaagtggcacatgctgttagcatcttaacagcaggcatgcaggaacaagaaagcagtggtcctcaagaacttgagactgtggtagtgacaggagaaactatggaagctctggaagctgttgcagctactgaagagtatccatcggtatctacactttctgaccaaagtattatgcaagtggttaattatgtattagcacaacagcaaggacagaagctatctgaagttgcagaagctattcaaactgttaaagtagaggtagcacatatttcaggaggagaatgagtatgttaatgaagataaaaagaagtgacatctcttgtacactgaactcacagaacatttgtttacaattctgtgtgactgtctgcttggagtttacatatcaaagttctgggctgtttggtaacgtaacgtttccaaacattttgtctggccaatgggttctatagaaaagaccgtttagtgtagagaaattgaaaacagatctattaggttggtgcaattgcttttgcaccaacctaatatttgatggcagtggtttatcatgatataccttttatgaattaatgtttataaatgactgtactgaatttaaaaccgtacagtttcatttgcattttgacattactttattatacattttgcatttaaaaggctgcaccagttggcttttcttctgttttattctcaaaatatagagattctgtgatttatttgccctgtttatggattaaaaagaaaattctaatataaagcatttcaataggatgcataggtatattacgttttttaaatgctttagatctgtgattcttgacttactatttattttatccccttttaagtcagggatgctttattctattttaaagcacttatgagttacatgttgtaatcaagtttgcacaatatatttatctatatgaggaacccataaatgaatagctaatttttaaaatgccattaaaatgcatgaaatgcttattaaaaccttactatactatttcttcaagggcaagtaaattgaccatgagaaaagaacacagttattaaacactgttgacaggaaaattctccttgataacataggacaattaatggaaaaaaaaattctcattatttgcaaagaatgaacaagttaatgaacaaacaaactagatttggtatgttttcagcttttgtatcatgtttaattgtttaatttggttgaaaaactgcagttgagaaatcagatagcaatatagacattcacagcagctctgtggataccatgtaattgtcaggtaatttcagaatgttgaaaattattcagtgcagccctcatagtatcatacttgaagaaattgattaccgttccactaaattgttgaagataaattatttttaaaggttatgaaaactaagttatattaattcatatgtttgatttttaaatcccacctcctcaagctatccaattttctgactttgaaaataaccatgagagatgccacatttctctctgggaaactaccactcaaagaataattgttaaaaattaagcttttaggtattagaagctgttataaagtataaaattaagatataagcagatcacatgtaaatcattcctaaagcacaagaaaagaatgtgccttgatgtacatatattactaagttgcctctcccagtttactttaaaaatggctttaaggataaagaataaatgtgatagctgtgcatgcattatatatttgcatttgcaaatttcccattgttttaacagctgtgtggctgactttcaattttaagacgtgaattgacatacagcccataactttataatggctgctcatttatcttatctttcagttagtggaaaaacatttcaacctgactaaaatttggaattgtgtctttttatgttccatcctctgttgttactagatttagtttaaaaattgtgtatgaccattaatgtatgtcataaacatgtaaataaaagatgttgaatcttgttgaaagcgcggcc

SEQ ID NO: 4 - DNA, 1730 bp, Homo sapiens
ccttcataccggcccttcccctcggctttgcctggacagctcctgcctcccgcagggcccacctgtgtcccccagcgccgctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcggaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaaaaaaaaaaaaaaaaaaaaaaaaa

SEQ ID NO: 5 - DNA, 1717 bp, Homo sapiens
gcgttttgccacagagccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaaggtgagtgagtgggggcgtgcttgggaggcgcaggatggcaccggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactctaaaaaaaaaaaaaaaaaaaaaaaaa

SEQ ID NO: 6 - DNA, 12227 bp, Homo sapiens
tgagctgcgaggcccgagagtcagaacctgggggagagggatggtctctgcacgggggggagccggaggagccgccgccgctgccgacgccaccgccgcagccgccgccgccgccgccccggcacccgcctcccggcgctgacggtctcgtacgaagccggcgagggggagccagcagcggcggtcgccggcacgccgcccagcatggtccgggaaaccaggcatctctgggtgggcaacttacccgagaacgtgcgggaagagaagatcatcgagcatttcaaacgatatggccgcgtggaaagtgtcaaaattcttcccaagaggggatctgaaggaggagtggctgcctttgtggattttgtggacatcaaaagtgcacagaaagctcacaactcggtcaacaaaatgggtgacagagacctacgcacggattataatgaaccaggcaccatcccgagtgctgctcggggattggatgatacagtttccatagcatctcgtagtagagaggtttctgggttcagaggaggtggtggagggcctgcttatggtcccccaccgtcacttcatgcacgagaaggacgttatgagcggagacttgatggggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacagcagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccagaaacagaaagtgaaaatgaatttcgccccttggatgaaaggatagatgaatttcaccccaaagcaacaagaactctctttattggcaaccttgaaaaaaccactacttaccatgaccttcgcaacatcttccagcgctttggagaaattgtggatattgacattaagaaagtaaatggagttcctcagtatgcgtttctgcaatactgtgatattgctagcgtttgtaaagctattaagaagatggatggggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaatttaaaagcagaaaagcaaaaaccagaggtcaagaaaagcagtccagagatggaggatgctcgcgtgctttcaaaaaagcagcctgacgtgtcctctagagaggtcattctgctgagggaaggagaggctgaaagaaagcctgtgaggaaagaaattcttaaaagagaatctaaaaaaatcaaactggacagacttaatactgttgccagccccaaagactgtcaggagcttgccagtatttctgttgggtctggctcaaggcccagctcagacctacaagcaagactgggagaactagcaggtgaatctgtggaaaatcaagaagtccaatcaaaaaagcccattccctcaaaaccacagctcaaacagctgcaggtattagatgatcaaggaccagagagagaagacgttaggaaaaactattgcagtcttcgtgatgaaacacctgaacgtaaatcaggccaagagaaatcacattcagtaaatactgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgattccattcaagaaccagtagttctgttccatagcagatttatggagctcacacggatgcaacagaaagaaaaagaaaaagaccagaaacccaaagaggttgagaaacaggaagatacagagaatcatcccaagaccccagaatctgctcctgagaataaagattcagaactgaaaactccaccttccgttgggcctccaagtgtcacagtcgtaactctagaatcagccccatcagcactagagaagaccactggtgacaaaacggtagaggcgcctttggtaacagaagagaagactgtggagccagctaccgtctcagaagaagcaaagcctgcatctgaacctgctcctgcccctgtggaacagctggaacaagtagacctgcccccaggagcagaccccgataaagaagctgccatgatgcctgcgggtgttgaggaaggttcatcaggtgaccagccgccttatctggatgccaagcctccaactcccggggcctcgttttcccaggcagagagcaacgtagatccagagcctgacagtacccagccactttcaaaaccagctcagaagtctgaggaagccaatgagccaaaggccgaaaagccagacgccactgcagatgctgagcctgatgcaaaccagaaagccgaagctgctcctgagtctcagcccccagcttctgaagatttagaggttgatcctccagttgctgcaaaggataaaaagccaaacaaaagcaagcgttcaaagacccctgttcaggcagctgcagtgagtatcgtggagaagcccgtcacaaggaagagtgagaggatagaccgggaaaaactcaagcggtccaattctcctcggggagaagcacagaagcttttggaattgaagatggaggcagagaagattacaaggactgcttctaaaaactctgctgcagaccttgaacatcccgaaccaagtttgcctctcagccgaacaaggcgccggaatgtaaggagcgtctatgcaaccatgggtgaccatgaaaaccgctctcctgtcaaagagcccgttgagcaaccaagagtgaccagaaagagattggagcgagagcttcaggaggctgcagcggttcccaccacccctcggaggggaaggcctccaaagacacgccggcgagccgatgaagaggaggagaacgaggccaaggaacctgcagaaacactcaagccacctgagggatggcggtcgccaaggtcccagaaaactgcagctggtggtggaccccaagggaaaaagggaaaaaatgaaccgaaggtggatgctacacgtcctgaggccaccactgaggtgggcccccaaataggcgtgaaagagagctccatggaacccaaggctgctgaggaggaggcagggagtgaacagaaacgtgacagaaaagatgctggcacagacaaaaacccccctgaaaccgcccctgttgaagttgtagagaaaaaaccggcccctgaaaaaaactccaaatcaaagagaggaagatctcgaaactccaggttagcagtggacaaatctgcaagtctgaaaaatgtggatgctgctgtcagtcccaggggggctgcagcacaggcaggggagagggaatctggggtggtggcagtctcccctgagaaaagtgagagtccccaaaaggaggatggtttatcatcccagttgaaaagtgatccagttgatccagacaaggaaccagagaaagaagacgtgtctgcctctgggccgtccccagaagccacccagttagccaagcagatggagctggagcaggccgtggaacacatcgcaaagctcgctgaggcctctgcctctgctgcctataaggcagatgcaccagagggccttgccccagaggacagggacaagcctgcacaccaagcaagtgaaacagagctggctgcggccatcggctccatcatcaatgacatttctggggagccagaaaacttcccagcacctccaccttatcctggagaatcccagacagatctgcaaccccccgcaggtgcacaggcgctgcagccttctgaggaaggaatggagacagatgaggctgtatctggcatcctggaaactgaggctgctacagaatcttctaggcctccagtcaatgctcctgacccctcagccggcccaacagataccaaggaagccagaggaaatagcagtgaaacctcacactcagtgccagaagccaaagggtctaaagaagtggaagtcactcttgttcggaaagacaaagggcgccagaaaacaacccgatcacgccgcaagcgaaacacaaacaagaaagtggtggctcctgtagagagccatgtccctgaatccaaccaagctcaaggtgagagtcctgctgcaaatgaggggacaacagtacagcaccccgaagccccacaggaagaaaagcagagtgagaaaccccattccactcctcctcagtcatgtacttctgacctaagcaagattccctccacagagaattcgtcccaagaaatcagtgttgaggaaaggactccaaccaaagcatctgtgcccccagaccttcccccacctccccagccagcaccggtggatgaggagcctcaagccaggttcagggtgcattccatcattgaaagtgacccggtgaccccacccagcgatccaagcatccccatacccacactgccttctgtaactgcagcaaagctctcacctcctgtcgcctctggggggatcccacaccagagcccccctactaaggtgacagagtggatcacaaggcaggaggagccacgggctcagtctactccatctccagctcttcccccagacacaaaggcctctgatgttgacaccagctccagcaccctgaggaagattctcatggaccccaagtatgtgtctgccacaagtgtcacttccacaagtgtcaccacagccattgcagagcctgtcagtgctgccccttgcctacatgaggccccgcccccgccagttgactctaaaaagcctttagaagaaaaaacagcacctccagtgacaaacaactctgagatacaagcctcggaggtgctggtagctgctgacaaggaaaaggtggctccagtcattgctcccaaaattacctctgttattagccggatgcctgtcagcattgacctggaaaattcacagaagataaccttggcaaaaccagctcctcaaaccctcactggtctggtgagcgcactcactggcctggtgaacgtctccctggtcccggtgaatgccctgaaaggccccgtgaagggctcagtgaccacactgaaaagtttggtgagcacccctgctgggcccgtgaacgtcctgaaagggcctgtgaatgttcttacggggccagtgaatgttctcaccactccagtgaacgccacggtgggcacagtgaatgccgccccaggcacagtcaatgccgctgcgagtgcagtgaatgccacagcaagtgcagtgaccgtcacagcgggtgcggttactgctgcatctggtggtgtaacggccacaacaggcacggtgacaatggcaggggcagtgattgcgccgtcaacaaagtgcaaacagagagcgagtgctaatgaaaacagtcggttccacccagggtccatgcctgtgatcgacgatcgtccggcagacgcgggctcaggggcggggctgcgtgtgaacacttctgaaggggttgtgctcctgagttactcagggcagaagaccgaaggcccacagcggatcagcgccaagatcagccagatccccccggccagtgcaatggacattgaatttcagcagtcagtgtccaagtcccaggtcaaacctgattctgtcacagcatcgcagcctccatccaaaggccctcaagctcctgcaggctatgcgaacgtggccacccattccacgttggtactgaccgcccagacatataatgcctctcctgtgatttcgtctgtgaaggccgataggccatccttggagaagcccgagcccattcacctctcggtgtccacgcctgtcacccagggaggcacagtgaaggttctcacccaggggatcaacacaccccctgtgctggttcacaaccagctggtcctcaccccaagcattgtcaccacaaacaagaagcttgctgaccccgtcacccttaaaatcgagaccaaggtccttcagccggccaacctggggtccacgctcacgccccaccaccctcctgctctgcccagcaaactgcctacagaagtcaaccatgtcccctcggggcccagcatcccagcagatcgaactgtctcccatttggcagctgcaaagctagatgctcattctcctcgaccaagtggacccgggccatcctcattcccaagggcaagccaccccagcagtactgcatctacggcgctctccaccaacgccacagtcatgctggctgcaggcatcccagtgccccagttcatctccagcatccacccagagcagtctgtcatcatgccaccccacagcatcacccagactgtgtccctgagccacctctcccagggcgaggtgagaatgaacactcccacgctgcccagtatcacctacagcatccggccagaagcgcttcactctcctcgggctccgctgcagccccagcaaatagaggtcagggccccacagcgtgccagcaccccgcagccagccccagctggtgtgcctgcactggcctcccagcaccctcccgaggaggaagtgcattatcaccttcctgtcgctcgagccacagcccctgtgcagtcagaggtactagtcatgcagtctgagtaccgactgcacccctatactgtgccacgggatgtgaggatcatggtgcatccacatgtgacggcagtcagcgagcagcccagggccgcggatggggtggtgaaggtgccaccagccagcaaggcccctcagcagccagggaaggaagctgccaagacaccagatgccaaagctgcccccacccccacccctgcccccgtccctgtccctgtcccccttcctgcccctgctcctgcccctcatggtgaggcccgtatcctcacagttacccccagtaaccaactccaggggctgcctctgacccctcctgtggtggtgacccatggggtgcagattgtgcactccagcggggagctgtttcaagagtaccggtacggcgacatccgcacctaccaccccccggcccagctcacacacactcagtttcccgccgcttcctctgttggcctgccttcccggaccaagacagctgctcagggccctcctcctgaaggtgagcccctgcagcctcctcagcctgtgcagtccacacagcctgcccagcctgcaccaccctgcccgccctcccagctcggtcagcccggccagccaccaagcagcaagatgcctcaagtgtcccaggaggcaaaggggacccagacgggagtagagcagcctcgcctcccagctggacctgcaaacaggccacctgagcctcacacccaggttcagagggcacaagcagaaacaggcccgacttccttcccctcccctgtgtctgtctccatgaagcctgaccttccagtctctcttcccactcagactgccccaaaacagccgttgtttgtcccaacaacctctggccccagcaccccaccaggactggttctgccacacactgaattccagccagcccccaaacaagattcctctccacacctgacttcccagagacccgtggatatggttcaacttctgaagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtggagacagattactgtctgctgctggctctgccctgtggccgtgaccaagaggatgttgtgagccagaccgagtccctcaaggctgccttcatcacttacctgcaggccaagcaggcggcagggatcatcaacgttcccaaccctggctccaatcagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacac

SEQ ID NO: 7 - DNA, 4064 bp, Homo sapiens
atgcccgggccccgaggggctgctggcggcctggcccctgagatgcgcggggcgggggcggcggggctgctggcgctgctgctgctgctgctgctgctgctgctgggcctgggcggcagggtcgagggggggccggccggcgagcggggcgcaggcgggggcggggcgctggcccgcgagcgcttcaaggtggtctttgcgccggtgatctgcaagcggacctgtctcaagggccagtgtcgggacagttgtcagcagggctccaacatgacgctcatcggagagaacggccacagcacagacacgctcacgggctccggcttccgcgtggtggtgtgccctctcccctgcatgaatggcggccagtgctcctcgcgaaaccagtgcctgtgtcccccggacttcactgggcgcttctgccaggtgcccgcaggaggagccggtgggggtaccggcggctcaggccccggcctgagcaggacaggggccctgtccacaggggcgctgccgcccctggctccggagggcgactctgtggccagcaagcacgccatctacgccgtccaggtgatcgctgaccctcctgggcccggggaggggcctcctgcccagcacgcagccttcctggtgcccctaggcccgggacagatctcagcagaagtgcaggccccgccccccgtggtgaatgtgcgcgtccatcacccgcccgaggcctcagtccaggtgcaccgcattgagagctcgaacgccgagagcgcagccccctcccagcacctgctgccgcaccccaagccctcgcacccccggccgcccacccagaagcccctgggccgctgctttcaggacactctgcccaagcagccgtgtggcagcaaccccctccccggcctcaccaagcaggaagactgctgcggtagcatcggcactgcctggggccagagcaagtgccacaagtgtccccagctgcagtacacaggagtgcagaagccagggcctgtacgtggggaagtgggcgctgactgtccccagggctacaagaggcttaacagcacccactgccaggacatcaacgagtgcgcaatgccgggcgtgtgtcgccatggtgactgcctcaacaaccctggctcctatcgctgtgtctgcccacctggccatagtttaggcccctcccgtacacagtgcattgcagacaaaccggaggagaagagcctgtgtttccgcctggtgagccctgagcaccagtgccagcacccactgaccacccgcctgacccgccagctctgctgctgcagtgtcggcaaggcctggggcgcgcggtgtcagcgctgcccaacagatggcaccgctgcgttcaaggagatctgcccagctgggaagggataccacattctcacctcccaccagacgctcaccattcagggcgagagtgacttttcccttttcctgcaccctgacgggccacccaagccccagcagcttccggagagccctagccaggctccaccacctgaggacacagaggaagagagaggggtgaccacggactcaccggtgagtgaggagaggtcagtgcagcagagccacccaactgccaccacgactcctgcccggccctaccccgagctgatctcccgtccctcgcccccgaccatgcgctggttcctgccggacttgcctccttcccgcagcgccgtagagatcgctcccactcaggtcacagagactgatgagtgccgactgaaccagaacatctgtggccacggagagtgcgtgccgggcccccctgactactcctgccactgcaaccccggctaccggtcacatccccagcaccgctactgcgtggatgtgaacgagtgcgaggcagagccctgtggcccggggaggggcatctgcatgaacaccggcggctcctacaattgccactgcaaccgcggctaccgcctgcacgtgggcgccggggggcgctcgtgcgtggacctgaacgaatgcgccaagccccacctgtgcggcgacggcggcttctgcatcaactttcccggtcactacaagtgcaactgctaccccggctaccggctcaaagcctcccggcctcctgtgtgcgaagacatcgacgagtgccgggacccaagctcttgcccggatggcaaatgcgagaacaagcccgggagcttcaagtgcatcgcctgtcagcctggctaccgcagccaggggggcggggcctgtcgcgacgtgaacgagtgcgccgagggcagcccctgctcgcctggctggtgcgagaacctcccgggctccttccgctgcacctgtgcccagggctacgcgcccgcgcccgacggccgcagttgcttggatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaagccggcttcgcgcgcagccgcccgcacggggcctgcgttccccagcgccgccgctgacgccgccgacgccgccctcggcccagacctcggtgatcactgagggatttccgcgagctcggcctcacttctgccccgacttgtggctcggacccagggaccttcagggcccgcagaccctcccggcgccttgagacccgaggcgcccctaccggcccccctccccggttagcgggcggttgtaaggtctccggcgggcgctgcctgccttcctcccagagggtgtttcctagaaactgataaatcagatcgtgcctctttacccttggctttcgaaaaaaaaaaaaaaaaaa

SEQ ID NO: 8 - DNA, 4425 bp, Homo sapiens
cgcgcacgcgcacgggccggcggcgcgcgccgagcggggggcaccgcgcgggtgcagccacgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctgggcgggccaggctgtgctggccttccagcggtaccagattggcgccgactcggccctcttctcccaggactacatggaccccagccaggactccagcatgccttacgcgccctacgtggagcccactgggccggatcccgccggtatgggcggcacctaccagcagccggccaacaccttcgacaccgagccccagggctaccagtcgcagggctactgagccacagtgaccgcctgcccccgcccctccccatctgtcccctctctccacacccagcccctgctcctgcccaggctgccctgcccagcgcctcatcagcctctgccttgtcccactgaggtccagggtagctcggggcaggggtggggcagtccagtgttggggactgtctacgtatgtgcaagtatatcccagggcatgtgccccgcaggggcctagagggtgggggccaggggtatttgcattcatacattgtgtcatcaagcattccttgagcgcctactgggcatccggcctgtgctgggcatgggtggtgacattggcagaaatggccactggaaaggggagcgatgagctgtggaggaagccctggtggtaccagaggccagaatggtgggaaagacagatccagataatgctgggaagtgtggctacaccgtggcttggtcatagggtgagtgtaaacacccacaggacactgggggctgtcaccctgctctggcagtcctgctaagagtgtcagggccgtctccattttatggttgaggaaactgaggtctagagaggtcaagattacttgcccagaatcactcaggcagctagtgatagaggtggggccaagcccaggctgcccgactgcagaccacgtgctcttccctggccacccacctcctaccatccccacgcttggggcttccctgctcagtgttactgtcattctgggaggccttggggccctcagccccttgagacaccctgattctgctgcatgccaagggcctgttctgccccagctgttcctcctcccctggggacagccccacctccgggtccctccacccacatccccctggtcctacccctggcccttggcctcctccaagagggctcaccccgggtgctgctctgtgctctgcgtgtcccacagacgcttgttccagggggctccagcaaaccccttcgtggtctctcaaaggactgatcactgtccttgcctctaggaggggtcactaagcccttacctagggctgggtggacaacaaggcacagatgagggtgtgactggcccgaggtcacggtgagtgagtggcaaagctggccctgacgcctgggtttcttggccccagctgcccagcaggtgcctcgattccctgcccttgtgacctcccaggaaacagaactgatctgggacactatgtcacctctcctctcatctggggtcagtcagggttcgggggctgcagcagccaagcgcatgagaggtgtttccttggccttccagaaggcccactgtggagccagcctccctatgggaggcagagcggcaaggacagggctttggaatcagccaggtcggctcctgggctgtggccgtggagagacactgcccccaggatgacacaggcaagagcccctgaggcatgggaggcccagggaagaccatgggctgtaggggagagtgtggcaggtgacccaaaggcccaaagagggccgtggggcctgaggaggtcataatctcttctgagtgggggcaggtcgattcttgcacaaggtgggctcttcactgagccataagggacagggaggtatgggagagcgctgggggcccatccccctgtccacccagtgtccactggcctgtccttcagggagcagagcagagcaggtggtggacgggcccagtgctgggtgttttcaccaccatccccccatcccccatctaagaatcctaagaggcaggcgatccctcacctgcttactcactcagcagttacccggcccctgtgctggagataccaagggcatgggtggtccctgcttcgatggccccaaagctgggccagagttaagggaaagaggaggaagtcctaagcagagaagtagcaccattatccccatttaacagaagggaaactgaggctcggcaagcataggcgagttggcagtggaacacggatctaaactcaggtgtgtccaagtcctcccaaaggacagcagtgatggagaggaccccagccagctgtgtgacagctggttgttgctgacttcattttccaatccggagaaggggctctgtccacagtcccccgccgccaggtggcccacatgggaccagcatgggggcaggttatctgttggcctgaagagtgaaacctgtaccaggccaaaggtgagggcgtgagtgagggcaggagtgtttatggcagagtgaagttctgtgcccaccacaagaggctgtgagatgttctgaccctcacccactgtccaccaaaagcctctcctgctgatgggcactaggagacctcagggtactgcccatctgtttctcctcgggtgccagccagctgctggtgatcctcagccggagggcagggtaccaggtaagcttaactccatcttgggtgtttgtgacaggccctgcctgccaccctaggcagggaaagctgtcaagactcctgccaggaatggggggtgctgagtcatctcacgaagaatccctcactcttcccgggttcagcccagaagcccttccaggcatgatcttccccatcaggctgggctctggcagggacctgcccaggatggagatgagagagggtgagagatggagggcgagatttggatgggacccagggctcctgactctgccctggaaggttcatggggaaactcgctccttctgttggcagaggacagcccctggggaaccccaggcccaactctgtccggtatcccttttcctcccagctgccctcccctacttctcccttgctcccaaagctttccttggagaagggccctcctgcagctggaccctgcagggtggctccctcctccccatcaagcacaagagagggcccaggaaaaaaggtttcacataagtgtagagtcgcaaggacgcttagagtcggcagagtctggggtagggagacagcgacttgtccaaggtcaagcacagagggagaggttcaggagtcaggtcttctgccttctgagttggctcatcctgggcagtcacagactgtcctgcctgcacggctcctatccacctgggggtgtcgcagttgaggggctaattcccaggggactgacgttagttccctactccatccttccctggtgattcttgatcttcaaagcctcggggatcccaggtttccccatgtaactgagacaccctgcctgttagccctgggagacccctaaccttggcccaagacccctttgattctctaaggagcacgaaagggggaatgcccctcccaggagtttatgggagaagggactgggccggctgcctcccagcgatgcacttgacctgacactccccatgtcctggtgcgcacagcccttgtcggtgccccggcccctcccgcagcgttactgcctgtgtatagtataaatatatatattttctatatataagatgtataatataaggctccacaaatatatctgtgtgtgtgtgtgcgtgtgtgtgcggtgaagggcggtccccatcctgggcccccactctagacccccccaccacctggttaagtctcgagtgaatccagtggccccgtggcaccctcctttatgacatccatccatctgtggtgaaccaagtgaaggtggtgacttctggtgacatagtaataaagtgaagactcagaaccca

SEQ ID NO: 9 - DNA, 3891 bp, Homo sapiens
gcgcactctggggaaagcggagctgcaccccgccccgtattgctgctcagctcctcagctgtgcgtgcgagggacgtcgggggtggcgccgcagcagttgcccctggtaacgggggaggcagcaggaggaggaggaggaggagggactcggcgggaggatgggcttgctctcaattttgcgcaagttgaaaagtgcaccagaccaggaggtgagaatacttctcctgggcttggataatgctggcaagaccactcttctgaagcagcttgcatctgaagacatcagccacatcacacctacacagggtttcaacatcaaaagtgtacaatcacaaggttttaaactgaatgtatgggacattggtggacagaggaaaatcagaccatactggaagaattattttgaaaataccgatattcttatatatgtaatcgacagtgcagacagaaaaagatttgaagagacgggtcaggaactagcggaattactggaggaagaaaaactaagttgtgtgccagtgctcatctttgctaataagcaggatttgctcacagcagcccctgcctctgaaattgcagaaggactgaacctgcataccatccgcgaccgagtctggcagatccagtcttgctcagctctcacaggagagggcgttcaggatggcatgaactgggtctgcaaaaatgtcaatgcaaagaagaaataaaatctagacgaatggagatgcaggagctgcgggagccgaattcggtcctgaaaaacactaatttgctgctttctgaccaaatgtttttccatctgtgtacagctccagctgtttgaagagagggaacaacacggtttagaaagaatccccattccagcagtagatttaactgatctctgaggttcagtatcatttttcaaataaaggaattatattatttcctctgcataattgaaatagtattaaatgtctcaaagcacatgattagaaaatgagatcttttaaatgagcaagagattgcattgcagtttagacaattccagtgggcttttttttcctctcaaaaaaaaaaaaagaaaaagaaaaagaggaagaagcagctttgctgagttcatttatttactgacccgtcccttgcattccctccatggttttgaaaccacagacagtgtttgctggtgctgtcagtgatttttaccgtcactagcccagccaggcttcagtctgtccgacaggaagctgctgggtgggggtggggggagaaaaggcagataattaaaccatctcatcgtcttgcaggtcggagactacgtatgtaatcctcactctttggacagaaaaaaaaaaaaaagtctttcttgcagacaagtcactacagaaacataccccatcccacccacccctgcctctgccccagccagccacacagagaagcaaattcttatgacttttgactgtaatgacatctggaatgtaaggagaggtgggaggtttaattccagaaaaattacaaggtccttaaaaagctctcacatcgagggctcaggctagcgtaaacaggctttctccagctcagtggagcagtgagcagccgactctgagattagctggcttctccacggccgtcctatagacaggatttctaaagctcaaagaattctgtgtttaaacgatcacaataggccgctgctatcagattttagaaataaatgcagctttaccatgaacctgctccactgagaaaagccaggcagatcgatttttagatcaatttttacagtgctggcaacttggtggtgtgggatgctcctggatggagagggtttgctgctggggaggacatgggtgtgtgtgtgactgcaggggtcgtgtccaaggaatcaagagtcaccccagctgctgggctcctctgcctctctgcagcagaatgtccgtcctctgttgattgattggagaggaatagcagaacatttctcctgcccctcgttgcaaaacgagcttgtttccctgaacctcagaaatcctcagcttcaaacatggggaaacaggccagagcattgcccggctcctgaattaaactctgttctggtgcctgagctcaggggttttcagagaatgaataagagactgtccagtgactggtgggtccctgggggccagctgccttctcatcctgggaggtggcccttcccaagcccatcagggcgtgtgagcagactgaaggggccgctgcagcccctggccctcaatacccagctgcttctggctaagagtgcagcagagactgaggcatagccagcttcaaaagcgatctgacatgaaagtcattaacaaagccagccgtgaaaaggtgccccagagttgctgtggacagacctgtaaggacttgcaaaacaaaagaaagtgaggggtttttttaacctcagagctagctgctctctgcagcctcctccactggcttctctggctcacccaagctctcccttacagaggcaacacagaattataaggaatcagaaatcccccttctaccaggctgcaaatgtggctctagcacttgcaaattgttttttcttccgaatagttcagcagggacaagttatctgaggggcaaaatgcctgcttggaggtctgcaattttggaacactgcagtatggaactttggcattggagggtctgtaaaatatttttgttcttttaccaccaacttaggggactgttttaaagagccatcccaaggcctctcctagcaggcagaagccactcctctgataacggcctctgtaaatgttctgatttgctctcagctgcagagacacagagacactgcagatgtcacacgctttcatcttccctttgagcccttttgaaccctcctggggctctggggtagatgagagaagcctgaaaaaggcagagtttgaaagctcccatttaaaaacaaaatactttttaaagccctcttgcctcttccctgcccactcctgccccctgaccagaagacagaatttgaagctggaaagggaagaccccttttcccctcctcctgtccccagtgagtcttagcgagacttttgccctgcgcacaattgcatctgaatgtgcgggggagagggctgggggccggagggcaggcaaggcctggggggtgctcgtgatatgtgctcaagccagttgtgggaaaaactcgagtcctcccctcctcccgacctaccccgtgtggctgcttttggctggattccctgcacccagtgcaacacaccctttccccttcactctcccttggttactatggaaacaagggtgtcattgatgtgggctgagctggggaacatgtcggtgcacagctgaaagtcagcgattatgccggcggttagaaatgtgccagggttaaaggagtccgcagctcccacggctgctgggaggacatggtcctgcccccttccttcctccctccctccgtctccacttctctctccttgcttttgacaaatttctttattcccctctggactaaagtagtggctatttttgtgccactctgcgccccaccctcactgttggccgctccttatccggcctggcctggagggtgacaccatgtcaccctcaccaggactcgtctctccattcccgtcagagtttgctttgatttccctttcctttccttctcggggaccagttcttacttccttttatttttagctctgcactccatgtggtttcagggttcagtctgatccatcaaaaggttctttttttataatcccttttgaaaatgataatcaaaggaagagatgtggtgtttggtcatgtggaaaactcaatgtataatttagacgtctgtcaaaaatccgacaaataaaatttagctggaacgaaaaaaaaaaaaaaaaaaaaaaa

SEQ ID NO: 10 - DNA, 3811 bp, Homo sapiens
ctattgaagccacctgctcaggacaatgaaattcttcagttacattctggtttatcgccgatttctcttcgtggttttcactgtgttggttttactacctctgcccatcgtcctccacaccaaggaagcagaatgtgcctacacactctttgtggtcgccacattttggctcacagaagcattgcctctgtcggtaacagctttgctacctagtttaatgttacccatgtttgggatcatgccttctaagaaggtggcatctgcttatttcaaggattttcacttactgctaattggagttatctgtttagcaacatccatagaaaaatggaatttgcacaagagaattgctctgaaaatggtgatgatggttggtgtaaatcctgcatggctgacgctggggttcatgagcagcactgcctttttgtctatgtggctcagcaacacctcgacggctgccatggtgatgcccattgcggaggctgtagtgcagcagatcatcaatgcagaagcagaggtcgaggccactcagatgacttacttcaacggatcaaccaaccacggactagaaattgatgaaagtgttaatggacatgaaataaatgagaggaaagagaaaacaaaaccagttccaggatacaataatgatacagggaaaatttcaagcaaggtggagttggaaaagaactcaggcatgagaaccaaatatcgaacaaagaagggccacgtgacacgtaaacttacgtgtttgtgcattgcctactcttctaccattggtggactgacaacaatcactggtacctccaccaacttgatctttgcagagtatttcaatacacgctatcctgactgtcgttgcctcaactttggatcatggtttacgttttccttcccagctgcccttatcattctactcttatcctggatctggcttcagtggcttttcctaggattcaattttaaggagatgttcaaatgtggcaaaaccaaaacagtccaacaaaaagcttgtgctgaggtgattaagcaagaataccaaaagcttgggccaataaggtatcaagaaattgtgaccttggtcctcttcattataatggctctgctatggtttagtcgagaccccggatttgttcctggttggtctgcacttttttcagagtaccctggttttgctacagattcaactgttgctttacttatagggctgctattctttcttatcccagctaagacactgactaaaactacacctacaggagaaattgttgcttttgattactctccactgattacttggaaagaattccagtcattcatgccctgggatatagccattcttgttggtggagggtttgccctggcagatggttgtgaggagtctggattatctaagtggataggaaataaattatctcctctgggttcattaccagcatggctaataattctgatatcttctttgatggtgacatctttaactgaggtagccagcaatccagctaccattacactctttctcccaatattatctccattggccgaagccattcatgtgaaccctctttatattctgataccttctactctgtgtacttcatttgcattcctcctaccagtagcaaatccacccaatgctattgtcttttcatatggtcatctgaaagtcattgacatggttaaagctggacttggtgtcaacattgttggtgttgctgtggttatgcttggcatatgtacttggattgtacccatgtttgacctctacacttacccttcgtgggctcctgctatgagtaatgagaccatgccataataagcacaaaatttctgactatcttgcggtaatttctggaagacattaatgattgactgtaaaatgtggctctaaataactaatgacacacatttaaatcagttatggtgtagctgctgcaattcctgtgaatacccgaaacctgctgttataactcagagtccatatttgttattgcagtgcaactaaagagcatctatgtgccttcatcaagaagcccatgttttgagattttgctcatgaaccatctgcaacttgcttcatcataagaataatttataacttgaccttcaaagagattagagcatttgtttcatcttacagttggagttcaatgtaacattttaaatgcaatttattatttcagaaatttcccatgaaactaaaaatagaaaataagatatacaagttaattcggtacttggataaatcatttctgcattgttgttccagagaatttgctgagaaatcaaagccatggtcatctggtgatgaagagaaaagtttaatctaaatgatatgtgcatttcctcatttaaaaaatccaattggattattcttaatatatacatgtaatatgaaaattgagattgaagcactaattccaaaattatggctgaatatactaaataacagaaaagttacagataagaatttatttctactgaactctatagttagtgtaatataattcatatttttatgatattggcacactgagaaattcattttgtagagctatggataaggcttgctatgatttgcactattagtacagtatagttagaaaggaaagctgaacactataaaactattaacatattttcgtatatgagtaacaactttgcttaagtgtttatcttagttcagaaatacataatgtcatatgttaaaaataaagagatgtagaaatctaaatgaattatcactgtgtatacagacagaaaaatcacataactctggtgtgttaacattgcaatgaaaaaatgaaaaaaagaaggaaaaaagaataagaatgaaaactgctgacgtattacaaaacagaaaaataaatgatttaaaatcaaatcaaaaagaaaaaactaaacatttaaacaaaaatgggataagaatagtcttctagaagtgaggatgcgaaaaagaatgagtttccaattaccctgatgtgacaattacacattgtagacaggtagcaaaatatcacatacacccccaaaatatgtacaaatattatatatcaataaataaatttttaaagagtaagtgctattggcattccaaaattcagctaaaggaaaaatgatcaaaaacaaagtaaggtgcacagttagcaaaagatgcagatgttatatcacagcaattctcatgctaaaaatacaacaaaagacaaagcaaaaaataaacctttgcttttttttttttttttttttttttgagacggagtctcgctctgtcgcccaggctggagtgcagtggcgggatctcggctcactgcaagctccgcctcccaggttcacgccattctcctgcctcagccaaacctttgctatttttaatcttcgttggcactttccagctgttactgaccttgtcattttttattcaaataagattatttacaaacttattcttgaaactaaatatagtaaagagggtttttaaaataatatttaacatacgaattattaattggccatgttcattatttatctatgtttattaatgggccaatgcaaaaaatcattttttcaaagaaaaatttgtccatgtaaagcttaaattataatattgctgctttgtataactcttctatgtttattctattcatttgttcctttccctaccatattttacacatgtatttataatctgtagtatttattacatttctgcttttttctagtcattcaatttatcactgctgaattgcatcagatcatggatgcatttttattatgaaaaaataaaatgacttttcaaattaaaaaaaaaaaaaaa

SEQ ID NO: 11 - DNA, 3656 bp, Homo sapiens
gcccgcgctgcgagccttccatggtgcagcgcatgtgggccgaggcggccgggcctgctggcggcgccgagccgctgtttccgggctcccggcggagccgcagcgtgtgggacgccgtgcgcctggaggtgggcgtccccgacagctgcccggtggtgctgcacagcttcacgcagctagaccccgacctgccgcgcccggagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggcctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcaccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctcaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctactataaaaaaaaaaaaaaaaaaaaaaaaa

SEQ ID NO: 12 - DNA, 4195 bp, Homo sapiens
gagagaagctgctgctgctaatgctgctgctgctgctgccgccgccgccgctgctgctgctgctgttggtctgaggctgcagtaggtttctgtgcagcattgcagaatccacacctagagaacagaagacacagacacgtacgtctactacccttgttagaaggaagctttggatcttcggtggataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatataaaaaaaaaaa

SEQ ID NO: 13 - DNA, 3365 bp, Homo sapiens
agcatccggagcggagctgcagcagcgccgccttttgtgctgcggccgcggagcccccgagggcccagtgttcaccatcataccaggggccagaggcgatggcttgcctccatgagacccgaacaccctctccttcctttgggggctttgtgtctaccctaagtgaggcatccatgcgcaagctggacccagacacttctgactgcactcccgagaaggacctgacgcctacccatgtcctgcagctacatgagcaggatgcagggggcccagggggagcagctgggtcacctgagagtcgggcatccagagttcgagctgacgaggtgcgactgcagtgccagagtggcagtggcttccttgagggcctctttggctgcctgcgccctgtctggaccatgattggcaaagcctactccactgagcacaagcagcagcaggaagacctttgggaggtcccctttgaggaaatcctggacctgcagtgggtgggctcaggggcccagggtgctgtcttcctggggcgcttccacggggaggaggtggctgtgaagaaggtgcgagacctcaaagaaaccgacatcaagcacttgcgaaagctgaagcaccccaacatcatcactttcaagggtgtgtgcacccaggctccctgctactgcatcctcatggagttctgcgcccagggccagctgtatgaggtactgcgggctggccgccctgtcaccccctccttactggttgactggtccatgggcatcgctggtggcatgaactacctgcacctgcacaagattatccacagggatctcaagtcacccaacatgctaatcacctacgacgatgtggtgaagatctcagattttggcacttccaaggagctgagtgacaagagcaccaagatgtcctttgcagggacagtagcctggatggcccctgaggtgatccgcaatgaacctgtgtctgagaaggtcgacatctggtcctttggcgtggtgctatgggaactgctgactggtgagatcccctacaaagacgtagattcctcagccattatctggggtgtgggaagcaacagtctccatctgcccgtgccctccagttgcccagatggtttcaagatcctgcttcgccagtgctggaatagcaaaccacgaaatcgcccatcattccgacagatcctgctgcatctggacattgcctcagctgatgtactctccacaccccaggagacttactttaagtcccaggcagagtggcgggaagaagtaaaactgcactttgaaaagattaagtcagaagggacctgtctgcaccgcctagaagaggaactggtgatgaggaggagggaggagctcagacacgccctggacatcagggagcactatgaaaggaagctggagagagccaacaacctgtatatggaacttaatgccctcatgttgcagctggaactcaaggagagggagctgctcaggcgagagcaagctttagagcggaggtgcccaggcctgctgaagccacacccttcccggggcctcctgcatggaaacacaatggagaagcttatcaagaagaggaatgtgccacagaagctgtcaccccatagcaaaaggccagatatcctcaagacggagtctttgctccctaaactagatgcagccctgagtggggtggggcttcctgggtgtcctaaggcccccccctcaccaggacggagtcgccgtggcaagacccgtcaccgcaaggccagcgccaaggggagctgtggggacctgcctgggcttcgtacagctgtgccaccccatgaacctggaggaccaggaagcccagggggcctaggagggggaccctcagcctgggaggcctgccctcccgccctccgtgggcttcatcatgacctcctgctccgcaaaatgtcttcatcgtccccagacctgctgtcagcagcactagggtcccggggccggggggccacaggcggagctggggatcctggctcaccacctccggcccggggtgacaccccaccaagtgagggctcagcccctggctccaccagcccagattcacctgggggagccaaaggggaaccacctcctccagtagggcctggtgaaggtgtggggcttctgggaactggaagggaagggacctcaggccggggaggaagccgggctgggtcccagcacttgaccccagctgcactgctgtacagggctgccgtcacccgaagtcagaaacgtggcatctcatcggaagaggaggaaggagaggtagacagtgaagtagagctgacatcaagccagaggtggcctcagagcctgaacatgcgccagtcactatctaccttcagctcagagaatccatcagatggggaggaaggcacagctagtgaaccttcccccagtggcacacctgaagttggcagcaccaacactgatgagcggccagatgagcggtctgatgacatgtgctcccagggctcagaaatcccactggacccacctccttcagaggtcatccctggccctgaacccagctccctgcccattccacaccaggaacttctcagagagcggggccctcccaattctgaggactcagactgtgacagcactgaattggacaactccaacagcgttgatgccttgcggcccccagcttccctccctccatgaaagccactcgtattccttgtacatagagaaatatttatatggattatatatatatacatatatatatatatatgcgccacataatcaacagaaagatggggctgtcccagccgtaagtcaggctcgagggagactgatcccctgaccaattcacctgataaactctagggacactggcagctgtggaaatgaatgaggcacagccgtagagctgtggctaagggcaagccccttcctgccccaccccattccttatattcagcaagcaacaaggcaatagaaaagccagggttgtctttatattctttatccccaaataatagggggtggggggaggggcggtgggaggggcaggagagaaaaccacttagactgcacttttctgttccgtttactctgtttacacattttgcacttgggaggagggaggctaaggctgggtcctcccctctgaggtttctcaggtggcaatgtaactcatttttttgtcccaccatttatcttctctgcccaagccctgtcttaaggcccagggggaggttaggagactgatagcatgtgatggctcaggctgaagaaccggggtgctgtttaagtccctgcttttatcctggtgcctgattggggtggggactgtcctactgtaacccctgtgaaaaaccttgaaatataacactccatgcagga

SEQ ID NO: 14 - DNA, 1387 bp, Homo sapiens
ttccggggctagggagcgctttctcccgggaaccgcggctgtgacccaagtggcccggaccagtttggggctgcgtgcggcctgcctcaagcaaccaggtacgtaggtcggcggcccagctcggcgctgcggtgggagccggagggcgacagtcagagccggggtgccagcgggacgcgaccgccagatccacttaggaccccgtcgttctgcgaagcggccacgtctgagtcccggggcctcctcgtgctgcagatgtcgccttaggacctcggccaggataccctctgccatgctcttgtgctgcccgtgatcaccgactggcccttgtaagcaccttcgcagcaggaagcccagagctgcgcctgccctttctgaaggctgtggaagaggttggagtgggcgcatcttagcttgccccatccccatttgaggtctgtcggagctgcccttcagtgtgagcatccacaatgggtaccccagcctcggtggtcagtgagccacccccttggcaggccccgattgaggcccggggccgcaagcaggcctcggccaacatcttccaggacgccgagctgctgcagatccaaggcctgtttcaacgcagcggggaccagctggccgaggaacgggcacagatcatctgggaatgtgcaggggaccaccgtgtggctgaggccctcaagaggctgcgcaggaagaggcccccaaggcagaaacccctgggccactcgctacaccactgcagccgcctcagaatcctggagccccactctgcactggccaacccacagagtgccacagagacagcctccagtgagcagtatctgcactctaggaagaaaagtgccaggatccgccggaactggaggaagtcaggccccacaagctacctccaccagatcagacactgatccagggaaagagccaggaatggcagtgtcttccctcttgccaaaaggcctggggaggtgaaggaagagagactttaggcaagcagcccaaaggggtaaatgaaagcaagaggctgctgccactgacctgctccattcagaacaagactggatgcttctgttgagctctccattatgtgggacccattcctcaccaaaatgaggagagacagtgactgttcctgccacagtccttcccagtctaacactattcctgggctgcatgatattcccctgggagcaaagtgacaggcacttagatgcagcatttcaccactcatgctactaatcatctacctgctactactgtaaaccatggttccagcagcctgttccacacccccacaccatcaggatagcacagggaaactgtagtttaagtggcaaataaaaacatttgcatcaaaaaaaaaaaaaaaaaaaaaaaaaaaaaa

SEQ ID NO: 15 - DNA, 3422 bp, Homo sapiens
ctctttcaagggcaggtctccagcccagctctctgaaaacattttgctgaaaatataagcaaacatcggccttgtcctccttgtgttcatacactgtggaagcttttctctgcctcctccgtgagagtgcgtggccgggagaccagaaacgtggtcctttctcttgcctgtgagctggtgcagagatggaggaagaagaatatgaacaaattccccaggagaatcccccagaagagctgtcccaggatcctgtgctggagctgtcaggaggtctaagggagaaagaacagaagaccccaaggagactgaggctcattctcatggggaaaacagggagtgggaagagtgcaacaggaaacagcatcctcggcagggacgtcttcgagtctaaactcagcaccagacccgtgaccaagacctcccagagacggagccgagagtgggctgggaaggagcttgaggtgattgacacacccaacattctgtccccccaggtctcgccagaggtggcagacgctatctgccaagccatcgtcttatccgccccagggccccacgccgtgctcctggtgacacaactgggccggttcacggatgaggatcagcaggtggtcaggcgcctgcaggaggtctttggagtgggggttctgggtcacaccatcctggtgttcacccggaaggaagacctggctggcggctccctggaagactatgtgcgagagaccaacaaccaggcccttgcctggctggatgtgacccttgcacggcgccattgcggcttcaacaacagggcacagggggaggagcaggaggcccaactgcgagagctcatggagaaagttgaagccattatgtgggaaaacgaaggagattattacagcaacaaggcttaccaatatacccagcaaaactttcggctgaaagaactacaggaaaggcaagtaagccagggccaaggctctgaggacgtgcctggtgaggagtcttggctggaaggactgtcccagatccagaaggaatctgaggaagcccacagatgcctgctggggaaggctgacctttgagcctgtgctggacttgagccaaggacaccatcagcctttgcacccccctgtgtccagccctctgtttctctttccatcccatggagtgcttcccagtctccaggtcatgacgtctggtgtaggaagaggggcatggggcttgaggacagggtccagcatgcccagatcacattccagttccttcattccttcttccagaacatctgggtcctccctcctctgtgccccaacagcacgctgtcttcctattggaccttctatctcattggcattgcctttcatgagttacttgtctatactctgatagaaccaaagtttcttgagggcaggcctgtatcttttacttctgtgtaacttccacagcttttgactgcattggagtcatgcagtcacgtttggtgcggcaactccatgcaagctgttgaccagatgacttctcatctctccccacaccatgatggtttaaggtgcctgttgtgtctggtggctggaacatggcagtggtgctgagacatggggagggttggagactgggtggggagggttggagactgggctgggaggagagcaagcaggaacagggatggaggcaggaggagcagcccttttattcactcttgagctgtaacaaacaagccccgttggaacttcctagtgggaatgatgggagaagtttggggcagggtatccaagaagtcagactgtggtcaagtaggtggtcccttgccctggctacagaacatggaagcccctagggatgcaagtggacttgggcagaggaggtcacaccaccccaccaaggtagacttagattagagatgacttgcatctgttacttcccctttttccatgggtttcatggcccctcatgatatttgccttctgctcctagaaggcacagactactttcaacctgcctcgcccttcactgccacccctcccttctcccttgataatgggagcatgtggatggggtgtctgcgtgtgcaaacgggttccctagcaaagtatttgtgggggtccaatgcaaggaggcagggaagaaagggggcctgcaaaggaagcagtagagtgacttaaacatcttgcgaggcagcctgcctggtttatgggagaactctgaagcccatgatgttttcctggaaggctgttcctacagacggggtttataagtactgatactggacaggatgagaagggagtaggatgtcatcctgtctcaggcctcggataggaagctgcctgccagcaagaggagactgatgtgccccgggtgcaccccacctcctttgaggtccaagatgctcctggggagttgaccgacatttgggaagataataggaggcattggggaaactgctccccaatatattcctcttttcctttcttcaagctgcgtagcagggggcctttagctagtttctcccgagaggggcgggaagtacagctggtggagacagtgctgggagatgatcagaaatctcagggcacagcctcaggtctacctggacactcatccactgttggagatgctcaacagctagacacagatgctcacagccgacctgtggcctcttgctctgaagccatcccccatcttccctagacacagcagacatctgagaaagcttcagcatttctcttgctaacagattcagaaaagtgtctcaaagcagagcacagagttatttggtgtttgctgaagacagcctttgtgccacaatcacttattaaataagcgatcaatttcccattgaactgaacatgcaacatttatcatacattcagttctcattcacactccttaagatttggtcagaatttttatttctgttcatgtcttctacttttctactcctgtatgaataaaatattgatttgattacagtggctttgactataatgtgggagccaatttttgcctcagtcttcatttttatatttaccttgttattctcaggcatttttttcttctatgtgagagttaaaatcattctgtaatttccccccaaaatcatattggtattctagttggcaatgtcttacatttatgttaagtttgagggaattggtagttcaagtataagttaattaaggccattttatttctaagtgaacagacttgaaactccagagctactgaagtaaaagttagaatcatttgcattttcattcagataggagataattttgtaaattttgatgctattattttaactctattagcttaagtaatgtcataatagaaaacacaagcatttgaccaaatgagatccattcagcgactaactggcaaggcactcaaaacatgtcattcattaaatgttgtttttatttacctcaaaaaaaaaaaaaaaa

SEQ ID NO: 16 - DNA, 2835 bp, Homo sapiens
gtacagaagcaaaatcaaacctgctatttcagcactcctgtttttaacttggtgtctttagtgcttggattggtgggatgtttcggaatgggcattgtcgccaattttcaggagttagctgtgccagtggttcatgacgggggcgctcttttggcctttgtctgtggtgtcgtgtacacgctcctacagtccatcatctcttacaaatcatgtccccagtggaacagtctctcgacatgccacatacggatggtcatctctgccgtttcttgcgcagctgtcatccccatgattgtctgtgcttcactaatttccataaccaagctggagtggaatccaagagaaaaggattatgtatatcacgtagtgagtgcgatctgtgaatggacagtggcctttggttttattttctacttcctaactttcatccaagatttccagagtgtcaccctaaggatatccacagaaatcaatggtgatatttgaagaaagaagaattcagtctcactcagtgaatgtcgcaggccatttctaaaagtgctacagaggacagacagggttttgaggccaccctgattattgggatgcatctgcagcacatccaggacttgaatttcattacgagttcctaatagttgtatttctaaagatgtgtttcctagagaatgtacagccttatgacactgtagtgatgtttttataattttctaagtagatttttttatattaacaaattcatatacagaaaaaataaggtgttacaaaaaatggagagctcttatttttgtacagattctgtcgtttttttttatttgtgtgagatttatggaaatacactaaatgagtaattcaggttcagtacatttattacaaagtgaaatcaggggatattcatttgtaaattttattcttagtgaatgaactgtataattttttttatcaggagagcacttataaaattcaatttataaagatcatatacccaaatcataaagatttagttgatacattaacactaagatactctgatttttagcgaactaaacaaagtgcttctactgagaggcctttataccaccatgtacagtaactctaagtgaatacggaagaccttggttttgaaattctgccaccttgtttctccctgctcatgaggtcgcaccttttgctcttgctgctaattgcccattcgtagtgggtgtaatgccaggtggaatggtttcaacaagtcaggtgaaaaccatcctttattgttgctggcacaacttgatatatagtctgactcagaactgaagctcacatctcaaattcatttcatgccagtaaatgtggcaaagagaagaaaggcccaagagcgagacaagaagaatggagaagggggcagccaagaagaacttctgggttcagggtactgtttatttgctccttctcttcatgcctgtggctggatgtcccacaacactataagaaatataagtcaagccctttgtgttaagcaagaactacagactccatcttttcacccaaatcatgaatgaccaataaaaagcaagttattccagaggaagaagcagcccttgaaatgttaaggcttaggcttgaaaggtgaagagcaggaattctctctttcaaatcctagagcataaacccatgtgtggccaagtgagatcagccctcaagggcacatgccaagggcagagcagcccatgtagacagcttcggagggcatgggggtgtagggagttcggggtagctcctcattaactatttgttgggtgagtaaaggggtgaggctcagtggcaggtacctctgcaatgacaagctgcctcccctctatgtgtttagcatatgttattagaacatgtccgacacccctaccgctgccatttgggccctttaataaagccaagtagagaaatctggcaataaaaggcaaatgtaagcatgctttctttaagacgcatcataaatggttttctttaagtgaatggaagagtttgacagagatacacctttgtaagaaaacattaagaatgctggctggctgtggtggctcacacctgtattcccagcactttgggaggcctaggcaggaggattgcttgagcctgggacttcgagaccagactgggaaacatggcaaaatcccatctctacaacaaaaatacaaaaattagccaagtgcggtggtgtgcctgtagtcctagttacttgggaggctgaggtgggagaatcacctgagcccaggaggtggaggctgcagtgagccatgccaatgcactccagtctgggcaacagagtgagaccctgtctcaaaaataaataaataaataaatgaataaagagaatgctaatcatttctgggttcactgcgactcactgtagtgctggggatcccccttgtaacactggaactgaaaggcagtgatgaaagctatgtcaagcattcattattctgaagaggaggagaaatgccacatacctttcccatgggacctgtggtggaatgaatccatacttctgcctcacttcgagcagacttttgttctcggcgctcctcacgatggagtttcatgcttcattttcacatctctctgcacaattagattgggagctccttgagggcagagtacgtgccttaatctttatctttgtaatgccacaatgaacagagtgcctcctggtacactgtaggagcttaagaaatactcactgaatgcatgaatgaatgaatgaacaaatgaaggaatgactaaggatgtttgtagtgctataatatagaatgggatttactctgctttaccagttagtttcataataaacaaatagtctgt

SEQ ID NO: 17 - DNA, 1985 bp, Homo sapiens
actgtggctaagtgtggggaccagacaggactcgtggagacatccaggtgctgaagccttcagctactgtctcagttttttgaagtttagcaatggcgtctttctctgctgagaccaattcaactgacctactctcacagccatggaatgagcccccagtaattctctccatggtcattctcagccttacttttttactgggattgccaggcaatgggctggtgctgtgggtggctggcctgaagatgcagcggacagtgaacacaatttggttcctccacctcaccttggcggacctcctctgctgcctctccttgcccttctcgctggctcacttggctctccagggacagtggccctacggcaggttcctatgcaagctcatcccctccatcattgtcctcaacatgtttgccagtgtcttcctgcttactgccattagcctggatcgctgtcttgtggtattcaagccaatctggtgtcagaatcatcgcaatgtagggatggcctgctctatctgtggatgtatctgggtggtggcttttgtgatgtgcattcctgtgttcgtgtaccgggaaatcttcactacagacaaccataatagatgtggctacaaatttggtctctccagctcattagattatccagacttttatggagatccactagaaaacaggtctcttgaaaacattgttcagccgcctggagaaatgaatgataggttagatccttcctctttccaaacaaatgatcatccttggacagtccccactgtcttccaacctcaaacatttcaaagaccttctgcagattcactccctaggggttctgctaggttaacaagtcaaaatctgtattctaatgtatttaaacctgctgatgtggtctcacctaaaatccccagtgggtttcctattgaagatcacgaaaccagcccactggataactctgatgcttttctctctactcatttaaagctgttccctagcgcttctagcaattccttctacgagtctgagctaccacaaggtttccaggattattacaatttaggccaattcacagatgacgatcaagtgccaacacccctcgtggcaataacgatcactaggctagtggtgggtttcctgctgccctctgttatcatgatagcctgttacagcttcattgtcttccgaatgcaaaggggccgcttcgccaagtctcagagcaaaacctttcgagtggccgtggtggtggtggctgtctttcttgtctgctggactccataccacatttttggagtcctgtcattgcttactgacccagaaactcccttggggaaaactctgatgtcctgggatcatgtatgcattgctctagcatctgccaatagttgctttaatcccttcctttatgccctcttggggaaagattttaggaagaaagcaaggcagtccattcagggaattctggaggcagccttcagtgaggagctcacacgttccacccactgtccctcaaacaatgtcatttcagaaagaaatagtacaactgtgtgaaaatgtggagcagccaacaagcaggggctcttaggcaatcacatagtgaaagtttataagaggatgaagtgatatggtgagcagcggacttcaaaaactgtcaaagaatcaatccagcggttctcaaacggtacacagactattgacatcagcatcacctagaaacttgttagaaatgcaaattctcaagccgcatcccagacttgctgaatcggaatctctgggggttgggacccagcaagggcacttaacaaaccctcgtttctgattaatgctaaatgtaagaatcattgtaaacattagttctatttctatcccaaactaagctatgtgaaataagagaagctactttgtttttaaatgatgttgaatatttgtcgatatttccatcattaaatttttccttagcattgtaaaaaaaaaaaaaaaaaaaaaaaaaaaaaa

SEQ ID NO: 18 - DNA, 2622 bp, Homo sapiens
tctcccctcccgccgcccgggcgagcgacacggctgcggcccccctcccctcccttccctccctccctcccatccccccctccccgagacccaccggaccccgaacccagatggccgaaacgggctccccgtcttaacgatttggcgtctccctcgaccaccacctctttgtgcagcagcccccgggcagaccctgttccgagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttattttctatggaccaaccagattaatttaaatgccacaggaaacaaactttatgtgtgtgtgtatgtgtggaaaatggtgttcattttttttggggggggtcttgtgtaatttgctgtttttgggggtgcctggagatgaactggatgggccactggagtctcaataaagctctgcaccatcctcgctgtttcccaaggcaggtggtgtgttgggggccccttcagacccaaagctttaggcatgattccaactggctgcatataggagtcagttagaatcgtttctttctctccccgtttctctccccatcttggctgctgtcctgcctctgaccagtggccgccccccacgttgttgaatgtccagaaattgctaagaacagtgccttttacaaatgcagtttatccctggttctgaggagcaagtgcagggtggaggtggcacctgcatcacctcctcctcttgcagtggaaactttgtgcaaagaatagatagttctgcctctttttttttttttcctgtgtgtgtggcctttgcatcatttatcttgtggaaaagaagattcaggccctgagaggtctcagctcttggaggagggctaaggctttagcattgtgaagcgctgcacccccaccaaccttaccctcaccggggaaccctcactagcaggactggtggtggagtctcacctggggcctagagtggaagtgggggtgggttaacctcacacaagcacagatcccagactttgccagaggcaaacagccttccaattgcccctccacccccagctgaggcccggtcacctggtcaggacagagcaactgcatctaaaagcacaagaagacagaaacctgtaagctctgaccccacccccaccccttgagaggtcagcggaccacctccttagggacagaccctggcaggtcgctgcccaccgagatttcctcaagtgtgcatagatctgagaggagtcgggagtcgagactcgagattccatcatagcgtaggtgtgtggggttgggagccccctgatgggcttgtctgtgtttgcaccttgtcctgtgtctgaggtcctgtgactgtaccctcctttgccctgggacatctgtatctcttggctttgtaataaatgctgcatactttctaaaaaaaaaaaaaaaaaa

SEQ ID NO: 19 - DNA, 1140 bp, Homo sapiens
ggggagagagaggccggtcctggtctggccgctgcggctgctagcccgaggtctccaagccgggctgcggctccatcctcggctcctgggcaccgtctgcgaggctccgccgaccagagtgagaaagccgcgggcggcgaccgccgcatcatgtcagccaaggacgagcgggccagggagatcctgaggggcttcaaactaaattggatgaaccttcgggatgctgagacagggaagatactctggcaaggaacagaagacctgtctgtccctggtgtggagcatgaagcccgtgttcccaagaaaatcctcaagtgcaaggcagtgtctcgagaacttaatttttcttcgacagaacaaatggaaaaattccgcctggaacaaaaagtttacttcaaagggcaatgcctagaagaatggttcttcgagtttggctttgtgatccctaactccacaaatacctggcagtccttgatagaggcagcacccgagtcccagatgatgccagcaagcgtcttaactgggaacgttatcatagaaacaaagttttttgacgacgatcttcttgtaagcacatccagagtgagacttttctatgtttgaaagaagaatgtgtgtacatttcaagaatttgggttttttggagggaggaggaaactgtttacttttttcctccacacgtttgatttttgacacatacacccctaattccctcaacagcagaacctacctgcagccaccaggggaccagctctgtgtaggtaaccagatggctctttttcccaagccaccatcttccagctgaccagactaaactcccaaccccagaccagggcaggggacaggtctcaagtccttcccagcatacacacagggaacaaacacataccacaaaccggtaactgtacctgtcaccctccttgtctcctccttgggccctacaggctacacatctacctttggcccctggttttggaaaaattccgtgttcctgacccatgtttagttttttcctaccatttctatttcatacattctcatacatttaacttgtaaaatagactgtgatattattacataatgtaattaaaaatatgaattaaaatattcctacagtcaaaaaaaaaaaaaaaaaaaaaa

SEQ ID NO: 20 - DNA, 4242 bp, Homo sapiens
gaattcggcgctgagtgacccgagtcgggacgcgggctgcgcgcgcgggaccccggagcccaaacccggggcaggcgggcagctgtgcccgggcggcacggccagcttcctgatttctcccgattccttccttctccctggagcggccgacaatgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgccgacaagatcgagggcttcttggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacagcatcagtctccgagagttgaagaccatcttgcccctgatcaactttaaagtgagcagtgccaagttccttaaagataagtttgtggaaataggagcacacaaagatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcatgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgatgacgtcgtgcaggccatcaaagaccacgcctttgttacctcgagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaagcataagaagctgggcccccgaggcgatgtggatgtcaacatggaggacaagaaggacgaacacaagcaacagggggagctgtacatgtgggattccattgaccagaaatggactcggcactactgcgccattgctgatgccaagctgtccttcagtgatgacattgaacagactatggaggaggaagtgccccaggatataccccctacagaactacattttggggagaaatggttccacaagaaggtggagaagaggacgagtgccgagaagttgctgcaggaatactgcatggagacggggggcaaggatggcaccttcctggttcgggagagcgagaccttccccaatgactacaccctgtccttctggcggtcaggccgggtccagcactgccggatccgctccaccatggagggcgggaccctgaaatactacttgactgacaacctgaggttcaggaggatgtatgccctcatccagcactaccgcgagacgcacctgccgtgcgccgagttcgagctgcggctcacggaccctgtgcccaaccccaacccccacgagtccaagccgtggtactatgacagcctgagccgcggagaggcagaggacatgctgatgaggattccccgggacggggccttcctgatccggaagcgagaggggagcgactcctatgccatcaccttcagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatacggaaagagatataaactccctctacgacgtcagcagaatgtatgtggatcccagtgaaatcaatccgtccatgcctcagagaaccgtgaaagctctgtatgactacaaagccaagcgaagcgatgagctgagcttctgccgtggtgccctcatccacaatgtctccaaggagcccgggggctggtggaaaggagactatggaaccaggatccagcagtacttcccatccaactacgtcgaggacatctcaactgcagacttcgaggagctagaaaagcagattattgaagacaatcccttagggtctctttgcagaggaatattggacctcaatacctataacgtcgtgaaagcccctcagggaaaaaaccagaagtcctttgtcttcatcctggagcccaaggagcagggcgatcctccggtggagtttgccacagacagggtggaggagctctttgagtggtttcagagcatccgagagatcacgtggaagattgacagcaaggagaacaacatgaagtactgggagaagaaccagtccatcgccatcgagctctctgacctggttgtctactgcaaaccaaccagcaaaaccaaggacaacttagaaaatcctgacttccgagaaatccgctcctttgtggagacgaaggctgacagcatcatcagacagaagcccgtcgacctcctgaagtacaatcaaaagggcctgacccgcgtctacccaaagggacaaagagttgactcttcaaactacgaccccttccgcctctggctgtgcggttctcagatggtggcactcaatttccagacggcagataagtacatgcagatgaatcacgcattgttttctctcaacgggcgcacgggctacgttctgcagcctgagagcatgaggacagagaaatatgacccgatgccacccgagtcccagaggaagatcctgatgacgctgacagtcaaggttctcggtgctcgccatctccccaaacttggacgaagtattgcctgtccctttgtagaagtggagatctgtggagccgagtatggcaacaacaagttcaagacgacggttgtgaatgataatggcctcagccctatctgggctccaacacaggagaaggtgacatttgaaatttatgacccaaacctggcatttctgcgctttgtggtttatgaagaagatatgttcagcgatcccaactttcttgctcatgccacttaccccattaaagcagtcaaatcaggattcaggtccgttcctctgaagaatgggtacagcgaggacatagagctggcttccctcctggttttctgtgagatgcggccagtcctggagagcgaagaggaactttactcctcctgtcgccagctgaggaggcggcaagaagaactgaacaaccagctctttctgtatgacacacaccagaacttgcgcaatgccaaccgggatgccctggttaaagagttcagtgttaatgagaaccactccagctgtaccaggagaaatgcaacaagaggttaagagagaagagagtcagcaacagcaagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaaggacatttcttaagacccaactggcatgagttggggtaatttcctattattttcatcttggacaacttctaacttatatctttatagaggattccccaaaatgtgctcctcatttttggcctctcatgttccaaacctcattgaataaaaagcaatgaaaaccttg

SEQ ID NO: 21 - DNA, 1187 bp, Homo sapiens
gcatgggggatgagctggcaccttgccctgtgggcactacagcttggccggccctgatccagctcatcagcaagacaccctgcatgccccaagcagccagcaacacttccttgggcctgggggacctcagggtgcccagctccatgctgtactggcttttccttccctcaagcctgctggctgcagccacactggctgtcagccccctgctgctggtgaccatcctgcggaaccaacggctgcgacaggagccccactacctgctcccggctaacatcctgctctcagacctggcctacattctcctccacatgctcatctcctccagcagcctgggtggctgggagctgggccgcatggcctgtggcattctcactgatgctgtcttcgccgcctgcaccagcaccatcctgtccttcaccgccattgtgctgcacacctacctggcagtcatccatccactgcgctacctctccttcatgtcccatggggctgcctggaaggcagtggccctcatctggctggtggcctgctgcttccccacattccttatttggctcagcaagtggcaggatgcccagctggaggagcaaggagcttcatacatcctaccaccaagcatgggcacccagccgggatgtggcctcctggtcattgttacctacacctccattctgtgcgttctgttcctctgcacagctctcattgccaactgtttctggaggatctatgcagaggccaagacttcaggcatctgggggcagggctattcccgggccaggggcaccctgctgatccactcagtgctgatcacattgtacgtgagcacaggggtggtgttctccctggacatggtgctgaccaggtaccaccacattgactctgggactcacacatggctcctggcagctaacagtgaggtactcatgatgcttccccgtgccatgctcccatacctgtacctgctccgctaccggcagctgttgggcatggtccggggccacctcccatccaggaggcaccaggccatctttaccatttcctagagttcttgagtccacagtctggcaagctgaggttaaaaatcatatgttgaatgcagcagtgtccacttatgactaacttcttagaacagcacaatataatagtggaattgggcctttcagaagacctcaactgatgatttt

SEQ ID NO: 22 - DNA, 1806 bp, Homo sapiens
ggccggagggagcccgcgctcggggcggcggctggaggcagcgcaccgagttcccgcgaggatccatgacctgacggggccccggagccgcgctgcctctcgggtgtcctgggtcggtggggagcccagtgctcgcaggccggcgggcgggccggagggctgcagtctccctcgcggtgagaggaaggcggaggagcgggaaccgcggcggcgctcgcgcggcgcctgcggggggaagggcagttccgggccgggccgcgcctcagcagggcggcggctcccagcgcagtctcagggcccgggtggcggcggcgactggagaaatcaagttgtgcggtcggtgatgcccgagtgagcggggggcctgggcctctgcccttaggaggcaactcccacgcaggccgcaaagggctctcgcggccgagaggcttcgtttcggtttcgcggcggcggcggcgttgttggctgaggggacccgggacacctgaatgcccccggccccggctcctccgacgcgatggggaaggtgctatccaaaatcttcgggaacaaggaaatgcggatcctcatgttgggcctggacgcggccggcaagacaacaatcctgtacaagttgaagctgggccagtcggtgaccaccattcccactgtgggtttcaacgtggagacggtgacttacaaaaatgtcaagttcaacgtatgggatgtgggcggccaggacaagatccggccgctctggcggcattactacactgggacccaaggtctcatcttcgtagtggactgcgccgaccgcgaccgcatcgatgaggctcgccaggagctgcaccgcattatcaatgaccgggagatgagggacgccataatcctcatcttcgccaacaagcaggacctgcccgatgccatgaaaccccacgagatccaggagaaactgggcctgacccggattcgggacaggaactggtatgtgcagccctcctgtgccacctcaggggacggactctatgaggggctcacatggttaacctctaactacaaatcttaatgagcattctccacccatcccctggaaggagagaaatcaaaaacccattcataggattatcgccaccatcacctctttcaattgccactttctcttcttttgaatttgaactctggagttactgttctacagtttggcggggacggggcttgggggttttctcttttgtttgtttccctttctttttcctttttttttttttttttttgttggctttgcgttaggatggctctgatctgacatttgacatgaacacaaagttgccaagatgctccttgttgacttccagcagaatgggaatgggggaaacacagcagttcttgggtaaaagtccctttgtaataataggtttgggatttttttatttcgagagaatctttcattttcctatgtatgcttttttccttttttgcccagtttccttatcacttgctgtagatggcttattttgcattcatgcagactatgttgcaagtctgtttcatctagtaaactgaaaattattgcttaatcaaactgccgtttgtcttttatatttaaggccttccccccccttccttatgagttctaacttagtaatttcaaatgtgaccttttatatctaagaccagtatagtaaacttagcccacagtggcaaataatgagtaatattgtaatatgttccagttgcacctcagtatgttaaacaggtaatgtaagaagttctctgaaatgtcagcaagtaagttctgaaacacatcatgcatgagtaggaataaac

SEQ ID NO: 23 - DNA, 5139 bp, Homo sapiens
agtctgcgccgggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaatctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcatctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagcggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtc

SEQ ID NO: 24 - DNA, 1157 bp, Homo sapiens
agaaatttctggaggtggtgtatcaaaatttactctgcgagactctgctgaactggctgcatcagggagaaatttcatctcccagaagggtgttgctcatcgtttcttcccggaaacatctgcagagactagcttttcaggctaaggtatcctccatgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatccccaaaactgtcaggaattccttggatcaccagaactcatcaactggaaacagcatttacagattcaaagttcacagcctagcctgaatgaggctatacaaaatcttgcagccattaagtccttcaaagtcaaacaaacacaacgcattctctatatggcagctgaaacagccaaggaactgactcctttcctgctgaaatcaaagattttatctcccagtggtggcaaacccaaggccatgtgagtttgataaaatccagtctataccactcacacctctcaagtaacctcccaacttctctccctgcattcactctggctttcctacaatcaatgttgtacaaagaaatcagaattacatttttaaaaaatgtaactcagaacatgtttctctcctgcttaaaagactccaccatctcccttctcatctagaataaaccaggcctctggctaccacttggacctttattgcccttcctgctttcttcctccaacagctctgaccttcactctgttcctctttcatcacaagctcatctatattccaggacttcacatttgttatttcttctgtctactctgtctctcaagacaatagaggtcacagcaaatacaaacctttatactaatggattttgttttcttcttggaccctccatagcaaccaagagatgtttaaactctcatccatggatgttacccatgctcacttggtgaataaattctggcattttggtggtaaaaaaaaaaaaaa

SEQ ID NO: 25 - DNA, 381 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagccggagggggtatagcagcagctggtttaacgtcgttgcctggttcgacccctggggccagggaaccctggtcaccgtctcctca

SEQ ID NO: 26 - DNA, 4190 bp, Homo sapiens
aagtgtctgtagcgtccctccctctcaaccacaataacaggcggagggtcggcgtaggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttaggtacctccctctgcaggatatcatgtgtatggaatgtctttcccggaagctaaaggaagcagtgaccctatatctgcgagttgtgagagttgtagatctctgtgcagggcggtggtgggaatacatgccaagtggctttacagatgccagttttctaacactattaaagaagatgccagatgttgaacagctatatggccttcaccctcgataccttgagaggcgaagagtaaggggccatgaggcttttagcattccaggagtcctagaagctttgcaggcatgcccaaacttagtgggtgtggaaacttctcatttggagttggtagaatccatttggacatatatgccccatgttcatattttggggaaatttcgtaatcgtaatggagcttttccaattcctcctgaaaataaactgaaaattcctataggagccaaaattcaaactttacatttagttggggtgaatgttcctgaaattccttgtatcccaatgctaaggcacctttatatgaagtgggtaagactcactaaaccacagccatttaaagacttcctttgtatcagcttaagaactttcgtcatgaggaactgtgcaggacccacaaattccttgaaatatgtccctttagtaacaggcttagcctctgcccgaaacttggaacacttagaaatggttcgagttcctttccttggaggtcttatccaacatgttgttgaagacagttggagatcaggtggttttagaaatttgcacactattgttctgggagcttgcaaaaatgctcttgaagtagatcttggttacctcatcattactgctgcccgtaggttacatgaagttcggatccagccttccctaaccaaagatggtgtcttttctgccctaaagatggcagagttggagtttccccagtttgaaacccttcatctaggatatgtagatgagtttttgctacagagcagaatggctaatgcggatctggtgaagtatggtttggctgatgtggtagaaaatcctggtatcatcactgatatagggatgaaagcagtcaatgaagttttttcctgtatcaaatatctggcaatttacaattgccctcatctacacaacccatacaattggatctcagaccactcaagatggactcgattggttgatatcaacctagtacggtgccatgctttgaagctggactcttttggccagtttattgaattattacccagcctagagtttatttcactggatcagatgtttcgtgaaccacccaagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaacctcaattactgttcatgattcagagagtgatgatgaagaagatagtctagaactccaagaagtctggattcctaagaacggtactcggcgttactctgaacgtgaagaaaaaactggagagtcagtgcagtccagagaattgtcagtaagtggaaaaggcaagactccacttcgaaagaggtacaactcccatcagatgggccagtcgaagcagtttcccctcgaggaaagcagctgtgagaaaggctgtcaggtcaccagtgagcagatcaaagccgatatgaaagcagctagggatattcctgaaaagaaaaaaaacaaggatgtttatcccagctgcagcagcaccaccgccagcacagtgggaaactccagctcacacaacactgcttctcaaagccccgactttgtaaggacggtgaacagcggcggctcttccgagcctagccctacagaagtggatgtgtccaggcagtgtgcctgctcccccggtgggtcagaggactctgaggccatggaggagggagatgcagagagttctgtctgccccagatgctgctgtcacaggccccaggaatcccaaaggagaactagcaggtgttctgatgaggaacgtccttcaaccagccgagcctgtgttgtgaatggcccggatgaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtgtttgtgtcttttgtgcttttttgttgttattaaaacaccaactaaaccttatagtcaagacaaggctctatgtttctgtacaaagctgtagttctttcttagtattatagttgccatgtttcttaaaatcaagtaaaaagacttatgagcttaaaaaaaagtgagtttgagagggaaatggaaaagtttccagagtatttctagtaatttatttccacattgaattgtgtatatgctttatcttgaatataaaataaaagtttattaaaaactttaaaaaaaaaaaaaaaaaaaaaaaaaaaaaaaaaaaaaaa

SEQ ID NO: 27 - DNA, 3362 bp, Homo sapiens
aaaaaatcaattttggaagatgtcactgaacaactcttccaatgtatttctggattcagtgcccagtaataccaatcgctttcaagttagtgtcataaatgagaaccatgagagcagtgcagctgcagatgacaatactgacccaccacattatgaagaaacctcttttggggatgaagctcagaaaagactcagaatcagctttaggcctgggaatcaggagtgctatgacaatttcctccacagtggagaaactgctaaaacagatgccagttttcacgcttatgattctcacacaaacacatactatctacaaacttttggccacaacaccatggatgccgttcccaagatagagtactatcgtaacaccggcagcatcagtgggcccaaggtcaaccgacccagcctgcttgagattcacgagcaactcgcaaagaatgtggcagtcaccccaagttcagctgacagagttgctaacggtgatgggatacctggagatgaacaagctgaaaataaggaagatgatcaagctggtgttgtgaagtttggatgggtgaaaggtgtgctggtaagatgcatgctgaacatctggggagtcatgctcttcattcgcctctcctggattgttggagaagctggaattggtcttggagttatcatcattggcctatccaccatagtaacgacaatcacaggtatgtccacgtctgctattgccacgaacggagttgttagaggaggtggggcctactatcttatttccagaagtttagggcccgagttcggtgggtcaataggcctgatctttgcttttgctaatgcagtggctgttgctatgtatgtggtgggattcgctgaaactgtagtagatctacttaaggagagtgattcgatgatggtggatccaaccaatgacatccggattataggctccatcacagtggtgattcttctaggaatttcagtagctggaatggaatgggaggcaaaggcccaagtcattcttctggtcattcttctaattgctattgcaaacttcttcattggaactgtcattccatccaacaatgagaaaaagtccagaggtttctttaattaccaagcatcaatatttgcagaaaactttgggccacgcttcacaaagggtgaaggcttcttctctgtctttgccatttttttcccagcagctactgggattcttgctggtgccaatatctcaggagatttggaggatccccaagatgccatccccagaggaaccatgctggccattttcatcaccactgttgcctacttaggggttgcaatttgtgtaggggcctgtgtggtccgagatgccaccgggaacatgaatgacaccatcatttctgggatgaactgcaatggttcagcagcatgtgggttgggctatgacttctcaagatgtcgacatgaaccatgtcagtacgggctgatgaacaatttccaggtcatgagcatggtatcagggttcggccccctcatcactgcgggaatcttttctgcaacactctcctccgccctggcctcccttgtcagcgcacccaaagtgttccaggctctgtgcaaggacaacatctacaaagccctgcagttttttgcaaagggatatgggaaaaacaatgaacccctgagaggatatattctcacttttcttatagccatggcatttattcttattgcggaactgaacaccattgctcccatcatctccaactttttcctggcctcatatgcacttattaatttctcctgcttccatgcctcttatgccaaatctccaggatggagacctgcgtatggaatttacaacatgtgggtatctctttttggagctgttttgtgctgtgcagtcatgtttgtcatcaactggtgggcagctgtcatcacctatgtcattgaattcttcctttacgtctatgtgacttgtaagaagccagatgtgaactggggctcctccacacaggctctttcctacgtgagtgctttagacaatgctctggaattaaccacagtggaagaccacgtaaaaaacttcaggccccagtgcattgtcttaacagggggacccatgacaagacctgctctcctggacataactcacgcctttaccaagaacagtggcctttgcatctgctgtgaagtctttgtgggaccgcgcaaactgtgtgttaaggagatgaacagtggcatggcgaaaaaacaggcctggcttataaagaacaaaatcaaggctttttatgctgcagtggcggcagactgtttcagggatggtgtccgaagtcttcttcaggcctcaggcttaggaagaatgaaaccaaacactctggtgattggatataagaaaaactggaggaaagctcccttgacagagattgagaactacgtgggaatcatacatgatgcatttgattttgagattggcgtggttatagtcagaatcagccaaggatttgacatctctcaggttcttcaggtgcaagaggaattagagagattagaacaggagagactagcattggaagcgactatcaaagataatgagtgtgaagaggaaagtggaggcatccgaggcttgtttaaaaaagctggcaagttgaacattactaagacaacgcctaaaaaagatggcagcattaacacaagccagtcgatgcatgtgggagagttcaaccagaaactggtggaagccagcactcaatttaaaaagaaacaagaaaaaggcacaattgatgtttggtggttgtttgatgatggagggttaacacttcttatcccctatatcttaactctcagaaaaaaatggaaagactgtaaattaagaatctatgtgggagggaagatcaaccgcattgaagaagaaaaaattgcaatggcttcccttctgagcaaatttaggataaaatttgcagacatccatatcatcggtgacatcaacattaggccaaacaaagagagctggaaagtctttgaagagatgattgaaccatatcgtctccatgaaagctgcaaagatttaacaactgctgagaaattaaaaagagaaactccgtggaaaattacagatgcagaactggaagcagtcaaggaaaagagttaccgccaagttcgactgaatgaactcttacaggagcactccagagctgctaatctcattgtcctgagccttcccgtggcaagaaagggatccatatcggatttgttgtatatggcttggttggaaatcctcacaaagaacctcccacctgtcttactagttagaggaaatcacaaaaatgtcttgacattttactcttaaaacatgaaagattggaatacattttaacttaatgtaatgcata

SEQ ID NO: 28 - DNA, 1615 bp, Homo sapiens
acttactcgtcatataaacccaaggcacagtcacatacccagggatacaagacactgcagactcccgagagacataacacagaattgcaccatgccaaactacaaactcacttattttaatatgagggggagagcagaaattattcgttacatatttgcttatttggacatacagtatgaagaccacagaatagaacaagctgactggcctgaaatcaaatcaactctcccatttggaaaaatccccattttggaagttgatggacttactcttcaccagagcctagcaatagcaagatatttgaccaaaaacacagatttggctggaaacacagaaatggaacaatgtcatgttgatgctattgtggacactctggatgatttcatgtcatgttttccttgggcagagaaaaagcaagatgtgaaagagcagatgttcaatgagctgctcacgtataatgcgcctcatcttatgcaagacttggacacatatttaggggggagagaatggcttattggtaactctgtaacttgggcagacttctactgggagatttgcagtaccacacttttggtctttaagcctgacctgttagacaaccatccaaggctggtgactttacggaagaaagtccaagccattcctgccgtcgctaactggataaaacgaaggccccaaaccaaactctagctgatccatgttgccttcaagtttgtttttctcgggggcatctctctcatcagataagacagctacatcagcctgccagataatccacatgctccctccccagctccactaagattttcactttagccatattctgatttttaaaaaggaaaataaaaacaaatctttcttcagtatctttttctttcagaatagcttctcatcatttacaattacagaaaaatagtatgtaatacaggcagaccttgctttgcacaggttctaacatgcacgaattgcagtcataatggtttagcaacaccattcttcccctcccccaaaatgttttggacttcagctaccacaattacctgtaattgcataaaacacaaactttgctagtagctctccagttcacatatcgctgtgtaaataacctatgtacatcatgaccaatgaccagtcacttctatcaaagactgccagaggtcactgcacatctgttattcctgcatagatagcaaagtgtgtagttgtattgctattgcctgcttgtggcccagtgataaatccctttgacattttacaaaaatgaatcaaaagagggaactccccaacaaagatgaaagtgcagcaaaggaacaaaaactgataatcctggaatgaaattcaaactgaatataaagagttatcgagaaaagagctgactgtgggaatctgacacggctcaaaaggctctagatatgcagccagagaaacttgtaaagatgaatttactgacatgaataaagttgttgtgatgagaaaaatgtagataccccagagatcaagagaaggagaagacaagccacagacttggagaaaatacttgtaaaacatgtatctgacaaaagactattattcaaaattatatagaactcataaaactcggctgactctcttttc

SEQ ID NO: 29 - DNA, 1099 bp, Homo sapiens
tcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatttgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcacggtctgcctcagtccaccctgtaccctggcccggtcctttggagtagaatggattgcaagttggctagtggtcacggtgcccaccattcttggcctgttacttacctgagatgagctcttttaactcaagcgaaacttcaaggccagaagatcttgcctgttggtgatcatgctcctcaccaggacagagactgtataggctgaccagaagcatgctgctgaattatcaacgaggattttcaagttaacttttaaatactggttattatttaattttatatccctttgttgttttctagtacacagagatatagagatacacatgcttttttcccacccaaaattgtgacaacattatgtgaatgttttattattttttaaaataaacatttgatataattatcaattaactgaaaaaaaaaaaaaaaaaaaaaaaaaaaaaaa

SEQ ID NO: 30 - DNA, 1500 bp, Homo sapiens
cggagggtggggagcggaaagcaggacgcacggctcccgcggcccgctggctgcccttcccgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatggc

SEQ ID NO: 31 - DNA, 2664 bp, Homo sapiens
agagccagcccggaggagctagaaccttccccgcatttctttcagcagcctgagtcagaggcgggctggcctggcgtagccgcccagcctcgcggctcatgccccgatctgcccgaaccttctcccggggtcagcgccgcgccgcgccacccggctgagtcagcccgggcgggcgagaggctctcaactgggcgggaaggtgcgggaaggtgcggaaaggttcgcgaaagttcgcggcggcgggggtcgggtgaggcgcaaaaggataaaaagcccgtggaagcggagctgagcagatccgagccgggctggctgcagagaaaccgcagggagagcctcactgctgagcgcccctcgacggcggagcggcagcagcctccgtggcctccagcatccgacaagaagcttcagccatgcaggccccacgggagctcgcggtgggcatcgacctgggcaccacctactcgtgcgtgggcgtgtttcagcagggccgcgtggagatcctggccaacgaccagggcaaccgcaccacgcccagctacgtggccttcaccgacaccgagcggctggtcggggacgcggccaagagccaggcggccctgaacccccacaacaccgtgttcgatgccaagcggctgatcgggcgcaagttcgcggacaccacggtgcagtcggacatgaagcactggcccttccgggtggtgagcgagggcggcaagcccaaggtgcgcgtatgctaccgcggggaggacaagacgttctaccccgaggagatctcgtccatggtgctgagcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgagcccacggcagctgccatcgcctatgggctggaccggcggggcgcgggagagcgcaacgtgctcatttttgacctgggtgggggcaccttcgatgtgtcggttctctccattgacgctggtgtctttgaggtgaaagccactgctggagatacccacctgggaggagaggacttcgacaaccggctcgtgaaccacttcatggaagaattccggcggaagcatgggaaggacctgagcgggaacaagcgtgccctgcgcaggctgcgcacagcctgtgagcgcgccaagcgcaccctgtcctccagcacccaggccaccctggagatagactccctgttcgagggcgtggacttctacacgtccatcactcgtgcccgctttgaggaactgtgctcagacctcttccgcagcaccctggagccggtggagaaggccctgcgggatgccaagctggacaaggcccagattcatgacgtcgtcctggtggggggctccactcgcatccccaaggtgcagaagttgctgcaggacttcttcaacggcaaggagctgaacaagagcatcaaccctgatgaggctgtggcctatggggctgctgtgcaggcggccgtgttgatgggggacaaatgtgagaaagtgcaggatctcctgctgctggatgtggctcccctgtctctggggctggagacagcaggtggggtgatgaccacgctgatccagaggaacgccactatccccaccaagcagacccagactttcaccacctactcggacaaccagcctggggtcttcatccaggtgtatgagggtgagagggccatgaccaaggacaacaacctgctggggcgttttgaactcagtggcatccctcctgccccacgtggagtcccccagatagaggtgacctttgacattgatgctaatggcatcctgagcgtgacagccactgacaggagcacaggtaaggctaacaagatcaccatcaccaatgacaagggccggctgagcaaggaggaggtggagaggatggttcatgaagccgagcagtacaaggctgaggatgaggcccagagggacagagtggctgccaaaaactcgctggaggcccatgtcttccatgtgaaaggttctttgcaagaggaaagccttagggacaagattcccgaagaggacaggcgcaaaatgcaagacaagtgtcgggaagtccttgcctggctggagcacaaccagctggcagagaaggaggagtatgagcatcagaagagggagctggagcaaatctgtcgccccatcttctccaggctctatggggggcctggtgtccctgggggcagcagttgtggcactcaagcccgccagggggaccccagcaccggccccatcattgaggaggttgattgaatggcccttcgtgataagtcagctgtgactgtcagggctatgctatgggccttctagactgtcttctatgatcctgcccttcagagatgaactttccctccaaagctagaactttcttcccaggataactgaagtcttttgactttttggggggagggcggttcatcctcttctgcttcaaataaaaagtcattaatttattaaaacttgtgtggcactttaacattgctttcacctatattttgtgtactttgttacttgcatgtatgaattttgttatgtaaaatatagttatagacctaaataaaaaaaaaaaaaa

SEQ ID NO: 32 - DNA, 2977 bp, Homo sapiens
gggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagtccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtgcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatg

SEQ ID NO: 33 - DNA, 1652 bp, Homo sapiens
aaagcttcccgagagccatggttggtccaggcaggcagtcggagcacctcgtggagcggctgctaacccagggtggggtggggtggggtggaggggtctgcttgtagtactctcagtcctgatgtcacaggcgcggcaaggacatcgcaaggaggagtcggattacagtaaggatgggcagtgcagcaggcagcccgagcgcactctccagccgccggggatcttagccctggaaaggcagcctgcaaggcgctcatcccgcggaggaggcacgctctcggcgctcactgctctccacgccggggacatttccaccgaatgtagcatgaaagggctctgctctacgtgccagccttgggtgagagctgatgctgaagacaccgcggtgggattccagctgtctgattaatgagaaacataatgtattttggtggtacatgccagagtcctgctctcccggcccttgtccgtccaccagcccctcctttgcaaccatcgctggatattaaaccatttcttccctttcctcttgacactgcagctgcagtcaacctcttccccaatttcaatgcgatggacccgattcagaaagctgtaataaaccatacattcggggttcctcttccccaccgaagaaagcaaatcatatcatgcaacatttgccagttgagatttaattctgatagccaggctgcggcccactacaaaggcacgaaacatgccaagaagctcaaagcactggaagccatgaaaaataagcagaaatctgtaactgccaaggacagcgcaaagactaccttcacctccatcactaccaataccatcaataccagctctgacaaaacagacggtactgcagggacaccagcaatatcaacgacgacaactgtggaaatccgcaaaagcagtgttatgacaactgagatcacctctaaagtggaaaaaagcccaacgacagccactggcaatagctcatgtccttctactgagaccgaggaagaaaaggcaaaacggcttctttactgttcgctatgcaaggttgctgtcaactctgcctcgcagctggaggcgcacaacagtggtactaagcacaaaaccatgttagaagcccggaatggaagtggcactatcaaagcctttcctagggcaggagtgaaaggcaaaggacctgttaataaaggaaacacaggcctccaaaataaaacatttcactgtgaaatctgtgatgtgcacgtcaactcggaaacgcaacttaaacagcacattagcagtagaaggcacaaagacagagctgctgggaagcccccgaaacctaaatacagtccttacaacaaactacagaagacagcacatccactgggggtaaaattagtattttcaaaagaaccttcaaagccattggctccacgaattctaccaaaccctctagcagctgcagcagccgcagcagcagtggcagtgagttcccccttcagtcttcgaactgctccagcagcaacactgttccagacttctgcgcttcctccggcactcctgcggccagctcccggacccattcggaccgcccacactcctgtgctgtttgctccttactaaattccaaataggagtaattgtactgcaataatttttcaaaaaacaaaaaacaaaac

SEQ ID NO: 34 - DNA, 3064 bp, Homo sapiens
ggggcactcagcaggttgggctgcggcggcggcggctggggaagccgaagcgccgcgcgtgagagatcccggatacatctgcggtttgggctccgccaccctccgtctctctcccgcaggtctctgagccgggtgcggaaggagggaacggccctagccttgggaagccaaagcacacccctggctcccgccgacaccgccctccttcccttcccagccgcgggcctcgctccgtgctcggctactctgccgggaggcggcggcggctgccagtctgtggcgagccctgctgccctccagccgggcttctccagccgggctcctccaccggcccttgcaggggcacagagagctcggcgcccgcccttccgctcgcctttttcgtcagccggctggaggagcatcggtccgggaggtctctgggctgaggcggcgacagctcctctagttccaccatgtccgcgggcggagacttcgggaatccgctgaggaaattcaagctggtgttcctgggggagcaaagcgttgcaaagacatctttgatcaccagattcaggtatgacagttttgacaacacctatcaggcaataattggcattgactttttatcaaaaactatgtacttggaggatggaacaatcgggcttcggctgtgggatacggcgggtcaggaacgtctccgtagcctcattcccaggtacatccgtgattctgctgcagctgtagtagtttacgatatcacaaatgttaactcattccagcaaactacaaagtggattgatgatgtcagaacagaaagaggaagtgatgttatcatcacgctagtaggaaatagaacagatcttgctgacaagaggcaagtgtcagttgaggagggagagaggaaagccaaagggctgaatgttacgtttattgaaactagggcaaaaactggatacaatgtaaagcagctctttcgacgtgtagcagcagctttgccgggaatggaaagcacacaggacggaagcagagaagacatgagtgacataaaactggaaaagcctcaggagcaaacagtcagcgaagggggttgttcctgctactctcccatgtcatcttcaacccttcctcagaagcccccttactctttcattgactgcagtgtgaatattggcttgaaccttttcccttcattaataacgttttgcaattcatcattgctgcctgtctcgtggaggtgatctattagcttcacaagcacaaaaaaagtcagcgtcttcattatttatattttacaaaaagccaaattatttcagcatattccggtgataactttaaaaattagatacattttcttaacatttttttcttttttaatgttatgataatgtacttcaaaatgatggaaatctcaacagtatgagtatggcttggttaacgagcagtatgttcacagcctgctttatctctccttgctcttctcacctctcccttaccccgttccctatttccgtgttcttacctagcctccccccacttcctcaaaacaaacaagagatggcaaagcagcagtccgaccaagcccactggaattatcctttaattttacagataccacttgctgtaggctgtggaccaagatgtccagaattattcttgagcactgatgtaaattacttagatcttctttgaggtcagaattcagcgatcacggtaggcagtgcttgaatgagaaaagcctcctggtgcatcttcaaaatgagtcctaaagaacatactgagtacttataagtagcagaacataaaatgtatttctgactaacacaaatggtcctttcacatgtgctttattagactctgggagagaaaagtaaccaagtgcttcagaacaggtttttagtatttacttcttcatggtaagataatgaagttctaatgaactatttctcccaaggttttaaaattgtcaagagttattctgtttgtttaaaaagtaagaaacctctgtaagcaatagattttgcttgggttttctttcttaaaaaaataatactatgcaggcaagacaccataaaagtttaattccttacagaagaaccagtggaagaatttaaatttggcactacgatcaaaactactgaattagcagaaataacgatatctaaagcttaccagcaaaagaaccctcagcagaatagcaaaaactttgctcaggacatttgaggtcaaattgaagacggaagacggaaaccggaaaccgttttcttgtaagcccctagaggcagatcaggtaagcatacatagtagagggaaaggagagaatggaaataaaactgaatattatgcagatttatgccttattttttagcattttttaaggttgggtctttcaggctggttttggtttgtattagatctgtatagtttagtgatttagttttatatttaagctacgattaatattttttctttggcgatatttctttgctttttttttttaacaactttccatttttagatgtttcgttgaatctatttagagcttcaccatggcaatatgtatttcccttaaaacactgcaaacaaatatactaggagtgtgcccttttaatctttactagttattgtgagactgctgtgtaagctaataaacacatttgtaaaaacattgtttgcaggaagaaaacttcgagttacaggtcaggaaaagcctgctgaatttatgttgtaaacgttacttaacacagtataaagatgaaaagacaacaaaagtatcttcatacttcctcatcccctcattgcaacaaaaccttaaactgggagaaccttagtcccctctctttcctcttcctcctccacttcccacttattgccactttgtaatattcagagagcacttggattatggatctgaatagagaaatgcttacagataatcattagcccacataccagtaacttatacttaaagatgggatggagttataaagtgcttttataatccaatataattgctaaaggcaagggttgactctttgttttattttgacatggcatgtcctgaaataaatattggttcactatg

SEQ ID NO: 35 - DNA, 2568 bp, Homo sapiens
atggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccatcgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttcgcagagcagccttttgagaaagctgccttccagaaacagaatgatacccccaagggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctggccactga

SEQ ID NO: 36 - DNA, 3245 bp, Homo sapiens
gccggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcctagcaaggttcaaaggcgatggcgtaaaatataaggccaagctgattggcattgatgatgtgccagatgcaagaggggataaaatgagccaagactctatgatgaaactaaagggaatggcggcacgtggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttaccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaaggattctagatgaccaaactaacaaactgaaatcgggtgttgaccagatggatttgtttggggacatgtctacacctcctgacctaaatagtccaacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctacctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttcctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggc

SEQ ID NO: 37 - DNA, 1135 bp, Homo sapiens
ccgcagccatgaccccgcagcttctcctggcccttgtcctctgggccagctgcccgccctgcagtggaaggaaagggcccccagcagctctgacactgccccgggtgcaatgccgagcctctcggtacccgatcgccgtggattgctcctggaccctgccgcctgctccaaactccaccagccccgtgtccttcattgccacgtacaggctcggcatggctgcccggggccacagctggccctgcctgcagcagacgccaacgtccaccagctgcaccatcacggatgtccagctgttctccatggctccctacgtgctcaatgtcaccgccgtccacccctggggctccagcagcagcttcgtgcctttcataacagagcacatcatcaagcccgaccctccagaaggcgtgcgcctaagccccctcgctgagcgccagctacaggtgcagtgggagcctcccgggtcctggcccttcccagagatcttctcactgaagtactggatccgttacaagcgtcagggagctgcgcgcttccaccgggtggggcccattgaagccacgtccttcatcctcagggctgtgcggccccgagccaggtactacgtccaagtggcggctcaggacctcacagactacggggaactgagtgactggagtctccccgccactgccacaatgagcctgggcaagtagcaagggcttcccgctgcctccagacagcacctgggtcctcgccaccctaagccccgggacacctgttggagggcggatgggatctgcctagcctgggctggagtccttgctttgctgctgctgagctgccgggcaacctcagatgaccgacttttccctttgagcctcagtttctctagctgagaaatggagatgtactactctctcctttacctttacctttaccacagtgcagggctgactgaactgtcactgtgagatattttttattgtttaattagaaaagaattgttgttgggctgggcgcagtggatcgcacctgtaatcccagtcactgggaagccgacgtgggagggtagcttgaggccaggagctcgaaaccagtccgggccacacagcaagaccccatctctaaaaaattaatataaatataaaat

SEQ ID NO: 38 - DNA, 808 bp, Homo sapiens
acactctaccaccatgaatccattcctgatccttgcctttgtgggagctgctgttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccgcccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaaagcccccggtccctctgcagtctctataccaataaagtggccctgctctca

SEQ ID NO: 39 - DNA, 2409 bp, Homo sapiens
gaattcgggcgcgaagcggccggcctgggcgccgactgcagagccgggaggctggtggtcatgccggggttcctggttcgcatcctccttctgctgctggttctgctgcttctgggccctacgcgcggcttgcgcaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgcccgaattc

SEQ ID NO: 40 - DNA, 1893 bp, Homo sapiens
attagacagcacactgctgactgttttcagttgtttctgtaacagcagaaagtgcactcactaggagtagtcagaattcaaaatgctcaagagaaagccatccaatgtttcagagaaggagaaacatcaaaaaccaaagcgaagcagcagttttgggaatttcgatcgttttcggaataattctttatcaaaaccagatgattcaactgaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaaggatgaggaagatggagagaatgcccacccatatagaaacagtgaccctgtgattgggacccacacagagaaggtgtccctcaaagccagtgactccatggatagtctctacagtggacagagctcatcaagtggcataacaagctgttcagatggtacaagtaaccgggacagctttcgactggatgacgatggcccctattcaggaccattctgtggccgtgccagagtgcatacggatttcacgccaagtccctatgacactgactccctcaaaatcaagaaaggagacatcatagacattatttgcaaaacaccaatggggatgtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaattattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagtttaaatgttttaatctgaataattgtacataaaattttgtatctctaacattccaaattactgtcaataaaatatatatttattattttaaatgctatgtgttaatatttcacttgcttgtattagaaaggcaaaatgtaagactttggtatgtgtgacatatgctttatttggctttattttacaagtacagtatctgcaaaaaacaaagtaaccttttttcatacctgccagttttgaatttatatatgttattgaacaaatagtaatagaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatattttaaaatttgacataccctaatgttaataataaaaagaactatttgcatattgcaaaaaa

SEQ ID NO: 41 - DNA, 1820 bp, Homo sapiens
ctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctggtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcct

SEQ ID NO: 42 - DNA, 2355 bp, Homo sapiens
cccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttattttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggtgtgcggttacagtctaaattttttcatcctcctatgcatcataagcatgtttgtaatattttcaaaaatagttctactgatgctacaggaatttcaagcctgtggtgaatgttagtatttaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatg

SEQ ID NO: 43 - DNA, 2208 bp, Homo sapiens
cgcgcgggccgggcctgcccctccgaggcgccgtagcgcgggagggaggcggcggcgctgtggtccgtgggtccgccggtccgtgggtctgcccggccgcccggccccgccctgccccccggggcggctcggctccatggcccgcggcggcggcggcggcggcggcggcgggaggcgacccgggggccgcggtggccgctgaccgggcggcgggaggcggcggggccgggccatgggggacggaaccgtccgcagccgccggagccgggagccctgcccaagtcggagcggcgtcccctgctgagccccgagcgccgggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgtgggcagactgctgatcgagttcacctcacccatgcccctggagcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaatcggccgctaccgcatgatcaagcacgaccgcgacaagcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttcactaggccccctagctacacctggaagtttcagaacccactttggggggcctcctgcctgggcaggctcttcaagtgtggccctctttggagtcaaccctccttcccgaccccctccccctagcccagccccagtcactgtcagggtcgggccagcccctgcactgcctcgcagagtggcctgggctaggtcactccacctctctgtgcctcagtttcccccccttgagtcccctagggcctggaagggtgggaggtatgtctagggggcagtgtctcttccagggggaattctcagctcttgggaacccccttgctcccaggggaggggaaacctttttcattcaacattgtagggggcaagctttggtgcgccccctgctgaggagcagccccaggaggggaccagaggggatgctgtgtcgctgcctgggatcttggggttggcctttgcatgggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatgg

SEQ ID NO: 44 - DNA, 3561 bp, Homo sapiens
ccggctgtcggtctccgtgtcgccgccgccgcccggcatcgtggagctggggcccccttttgcctgggagttttgtagtcgcctagggtcagcggtgacatcccaaagggcaggcccggcagccgccatggtggccaaggattaccccttctacctcacggtcaagagagcgaactgcagcctggagctacctccggccagcggtccggccaaggacgctgaggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaacatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtcatca

SEQ ID NO: 45 - DNA, 5724 bp, Homo sapiens
cgctccctcccgaggggccgcgcgcacgggaggacggagaggcggaaaggatggcgctgtgacagccgggccggagccctcgcgtccccaccccgcgccctggccgctgggcccggcgagatggagtccacagcctaccctctcaatttgagcctgaaagaagaggaagaggaagaagagattcagagccgggaactagaggacggcccggcagacatgcagaaagtacgaatctgctctgagggcggatgggtaccggccctatttgatgaggtggccatatatttttccgatgaggaatgggaagttttgacggagcaacaaaaggccctctaccgggaagtcatgaggatgaattatgaaactgtcctgtccctggaattcccattccctaagccagacatgatcacccgtttggaaggggaggaggagtctcagaattctgacgagtggcagctccaaggaggcacctctgcagaaaatgaagaatctgacgtaaagcctccagactggccaaacccaatgaatgctacctcccagtttcctcagcctcagcactttgacagctttggcctccgtctgcctcgggatatcacagagctgcccgagtggagtgaggggtaccccttctacatggccatgggcttcccagggtatgacctctcggctgatgacatagctgggaagtttcagttcagccggggcatgcgccgcagttacgacgcagggttcaagctgatggtagtggaatatgctgagagtaccaacaactgccaggctgccaagcagtttggagtattggaaaaaaacgttcgagactggcgcaaagtgaagccacagcttcaaaacgcccacgccatgcggcgggcattccgaggccccaagaatgggaggtttgctctggtggaccagcgtgtggccgaatatgtcagatacatgcaggccaaaggggaccccatcacccgggaggcgatgcagctgaaagctctcgaaatcgcccaggaaatgaacattccagagaaagggttcaaggcaagcttgggttggtgtcgaagaatgatgagaaggtatgacctgtctctgaggcataaagtgcccgtgccccagcacctgccggaagacctgactgagaaactcgtcacttaccagcgcagtgtcctggctctgcgcagggcgcatgactatgaggtagctcagatggggaatgcagatgagacgcccatttgtttagaggtgccatcacgggtaactgttgataaccagggcgaaaagcctgtcttggtcaagacaccaggcagggaaaaactgaaaatcacagcaatgcttggtgtcttggctgatgggaggaagttaccaccgtacatcattttgaggggaacatatatccccccggggaagtttcccagtgggatggaaattcgctgccaccggtatgggtggatgactgaagacttgatgcaggactggttggaagtggtgtggagacggaggacaggagcagtgcccaagcagcgagggatgctgatcttgaatggcttccggggccatgccacagattccgtgaagaactccatggaaagcatgaacactgacatggtgatcatcccagggggtctgacctcacagcttcaggtgctggatgtcgtggtctacaagccactgaatgacagtgtgcgggcccagtactccaactggcttctggctgggaacctggcgctgagcccaaccgggaatgctaagaagccacccctgggcctctttctggagtgggtcatggtcgcgtggaatagcatctcaagtgagtccatcgtccaagggttcaagaagtgccatatctccagcaacttggaggaggaagacgatgtcctgtgggaaatcgagagtgagttgccaggaggaggagaaccaccaaaagattgtgacaccgaaagcatggctgagagcaactgaagggaaagggaaagcaaatggaactctgatttaaacagctggggatgaaattcctcaagatgattattcctgaaagtgtggatgcgctggatgcgcagggaacatcaggaaaaggccacggggctctgaacagccccggtccagacagcagcctgtacatccatcccaggacacagcccagcccctccccacaccatacaaggtatcagaaaagtctaggacctatcatttcatcagagacatgatcagaaaagaaactgcttctgccccatttcttgttttggagattactccatctgtccatcaaaagaaacctgtaaatatgaaagaacaaaggttatttcctggagaaaagacaatttattcaacaccaacgagggactcatcatatgggcacaactctggtgtccttctatggagaaaacctcaagtaaagttttattctgcctttgaaaatgcttccaaaagtagaccctgtccccacacaggtcaagactacagagaaggctttgtagaaatgtgtcacctatgtacacctgctacttacacatttcctcttttggaaaaatgagatacttagaataacaagaaaattaagacatactggcctggtgccagcagatggcttttctatagacaaactaggttagtgtggaagatataggttaaaataaactatgctgttttatttatcttcccaacctgattggcagctagacttttttagggtctcatttaatggccctgtttttttcattattatatttaatgatagggcaggatttcgtatgcaagctcttgtttctcaggctgcctgcagaagaagtcgctataaattatctgttgtctacatggtacaaggcccattgactcatctgatgcttgttttgttaatttctttaatatttttatcacggggcagtgggagggcttgggcttttagccacagctgttttaagacttctgatctcctgccctgcaggaataggtgggaagtcattgaatttttacactatagtaatttgcattcccacataagtttgagtgttacgaaaacattcctttaaagggatctgtgctacacaaaatatgccaggacctcacagacaaagccattgctagaaatgtcattccaatgatcagatctggaaacaggctgccataaccacttttccttcttgtagactcagctcacctgtatatttaaactgttcttggcatcttgaaacacctatttctactcaggtactcattgtcctgttactgattcacctttctgatccttttcaaccagttttcccccaaggggggaaattttacttaacctctagtatttgaacaactcaatatttgaattgttgccccatttgcttttacctgtactgtattcttggtcatctcaaatggcgtctaaacccagctactttgcattccagaagtttccattccctccaattccacctaatttttcatctgtcctagttactggctctttcttcatgtcttatttctcttgctttgggagcttaaaagattttacaagacctaattttgggttccttccttggagccatagttaccctgccaagaagagtagaaaatgggttcaactcctgtttcgctccaccaacacctctgtgagtctcatcatcagctgagcgatgatgccttacaggttgcatagcactggaactttcctagagtaacggctctgctgccagggtttctctgggctcattcttccactgacttaattatgatctatgcctaacagagccccagtacaactattttgcagaatggctgttaccctagaattactatagcacatattgagatatagttgtactccctagtagataggaactgaccccaacaataaactttgataataaagacaataggctatggtgattttatttctttacctattagcattgtgaaaagttacattcaaggtattggctacaccttattctccatccggtttggtaccaatatattacatctttcagtcaaaaagtgttcatgagatgcagtgtaagtaatattggtatctgtgaagacacagggaagaacgtgtgcagtggggcaagtttgacataaatagcttttttcctcagtcatgttttgtatgctctcagcagtggtacattaccaaaatcacatgaaagaaatcccataaagggatctgaattttaaatgaaagtatgatgaacccgcaagtcttaattatgcacttttaataaaattagtcctgacaatttacagtgcccataaagtagtagttgattctccaggaataatctggcagtgttatttttccttttcaacccatcagcattaaatgctgagccactctccaagtctgacccctagactaagcttccttactcttactcttcctcccagaggcattttggaatgagtcaaaggcatggtaggacacggcatttacctgtggtcatcacttcaggcaatggaaaggaaaagtgtttgtccttggttgatcagagaagtgggtgataagaacgtgctaaataacaaacctgcacacttgtacctctgaacctaaaatgttttttttttaattcagaacaacaaaagaacatgctaagcgagtcctcccacctgcctggtaaaatacagccagctttatcacacctggttttgcacagtgataaattcctgcaggaaaaaataagttttattctaagtctgaaattatatggtttccaacagctttttccctcgttaaaataattatttttctacatgatgcttgataataagcatttgtttcttaacctaattagagaagcgattgcactcgagtccccacagctggcagtggtgttacagatggaaccagcctttggtggacagagttcagatgtttcaggggctcttgtgaaaatgctaagtattactgtttctaccttactgccctgcactttaccccatcatctcccctccttagaaaatgatttcataggaaaattggcatggagagcagatagtagagtgtagacctgaaatacatgaggcaaaggcagtcttccagcattctatggtcccaccaggtgggtaggtgactaggaattcaggccaggtcctagagagtagtgagaagttttccagtttgcagttttctctgtgctgtatgtacagccatacagcctatggaacctgacattgcagtgggcagcaggacacggtcaaggctcctagctgcctctccatctatggaactatgaaatttcacacatattccctaggcagcattaaggcccaggtatattgagtagtccaaaccaaaaaactatattcgagtatcagtttaaattcttccaagccctaaaaattcttacgtagtttctcacctaaaactaatggcttgtgccaagaactgaaactaagctattgatttttttttaagaagtcttaatctatacataagaaattacatacctggccaggtgcagtagttcaggcctgtaatcctaacaaacactctgggaggccaaggtgggcagactgcttgagctcaggagttcattaccagtctgggcaacatgataaaaccgtgtctttacaaaaaaaaaaaattttaaattagccgggcatggtggtgtgaatctgtagtcccagctacttaggaggttgcgatgggagaatcacctgagcccagaggtccagtctgcagtgagccatgatcacaccacagcactccagctggggtgacagagtgagaccctatctcaaaaagaaaag

SEQ ID NO: 46 - DNA, 1854 bp, Homo sapiens
cttttccggcccgcagcgcggcctgggctcccgcgtgtttaaaagtgcgcttgtggctgctgctgtcttaactcctgtgcttggcggacagacaggcgagatggcggcggaggtgttgccgagtgcgaggtggcagtattgtggggcgcccgacgggagccagagagctgtactggtccagttctccaacgggaagctacagagtccaggcaacatgcgctttaccttgtatgagaacaaagattccaccaaccccaggaagaggaatcaacggatcctggcagctgaaacagataggctctcctatgtgggaaacaattttgggactggagccctcaaatgcaacactttgtgcaggcactttgtgggaattttgaacaagacctctggccaaatggaagtatatgatgctgaattgttcaacatgcagccactattttcagatgtatcagttgagagtgaactggcgctagagagtcagaccaaaacttacagagaaaagatggattcttgtattgaagcctttggtaccaccaaacagaagcgagctctgaacaccaggagaatgaacagagttggcaatgaatctttgaatcgtgcagtggctaaagctgcagagactatcattgatacgaagggtgtgactgctctggtcagcgatgctatccacaatgacttgcaagatgactccctctaccttcctccctgctatgatgatgcagccaagcctgaagacgtgtataaatttgaagatcttctttcccctgcggagtatgaagctcttcagagcccatctgaagctttcaggaacgtcacgtcagaagaaatactgaagatgattgaggagaacagccattgcacctttgtcatagaagcgttgaagtctttgccatcagatgtggagagccgagaccgccaggcccgatgcatatggtttctggataccctcatcaaatttcgagctcatagggtagttaagcggaaaagtgctctgggacctggagttccccacatcatcaacaccaaactgctgaagcactttacttgcttgacctacaacaatggcagattacggaacttaatttcggattctatgaaggcgaagattactgcatatgtgatcatacttgccttgcacatacatgacttccaaattgacctgacagtgttacagagggacttgaagctcagtgagaaaaggatgatggagatagccaaagccatgaggctgaagatctccaaaagaagggtgtctgtggccgccggcagtgaagaagatcacaaactgggcaccctgtccctcccgctgcctccagcccagacctcagaccgcctggcaaagcggaggaagattacctagacgcatgctttccagacagggcgttttggctgcatcacagccactggctggtcctattcatttccatttttatgtatgttttgaaaagaaaaggtccggggatggtggctcacacctgaaatcccagcactttgggaggccgaggcaggaagatcattgagctcaggagtttgaaaccagtctggacaacatggggagaccccatctctaccggaggaaaaaaaaaagagtcaggcctggtggtgtgcgcctgtaatcccagctactcgggaggctgaggcaggacgattacttgagcttgggaaatcaaggttgcagtgagctatgattgtgtggccacactccatcctgggtcacagagtgagaccttgtctcaaaaaagtaacataaggaaaaaagaagccttgctttagcacaggtatgaagccagaagccagcatctcaactgtgcttgtcttatgcagaaatataaagcgatggccaggttggacttc

SEQ ID NO: 47 - DNA, 2536 bp, Homo sapiens
ggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcagcctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatggc

SEQ ID NO: 48 - DNA, 69 bp, Homo sapiens
gtttcaaggcactctagattccattggtccaagattccggatcctaagcatctaagttataagactctc

SEQ ID NO: 49 - DNA, 70 bp, Homo sapiens
cggtcattttcttaaaactgcaaacatttctctcgagtgtggactggcccggcttcggtgaaaggtgccc

SEQ ID NO: 50 - DNA, 69 bp, Homo sapiens
ctcctcaagctatccaattttctgactttgaaaataaccatgagagatgccacatttctctctgggaaa

SEQ ID NO: 51 - DNA, 69 bp, Homo sapiens
acagccaaggctggactgggttggctgcagtgtggtgtttagtggataccacatcggaagtgattttct

SEQ ID NO: 52 - DNA, 69 bp, Homo sapiens
ggaggcgcaggatggcaccggcacatctaacatctacacttctctagctcagcctcacaggccaaagca

SEQ ID NO: 53 - DNA, 69 bp, Homo sapiens
ttgcagactcttaacgcaggaaggacttcaaacttctgctgagaccttggggtcaaggaacatttcatt

SEQ ID NO: 54 - DNA, 70 bp, Homo sapiens
agatttgcaaggagggcaagtgcgtgaacacgcagcctggctacgagtgctactgcaagcagggcttcta

SEQ ID NO: 55 - DNA, 70 bp, Homo sapiens
cgtgaacgagggctacctcaacagcgcctccgagggggaggagttctgcatctacaaccgcaaccccaac

SEQ ID NO: 56 - DNA, 70 bp, Homo sapiens
gctgctttctgaccaaatgtttttccatctgtgtacagctccagctgtttgaagagagggaacaacacgg

SEQ ID NO: 57 - DNA, 70 bp, Homo sapiens
gttatggtgtagctgctgcaattcctgtgaatacccgaaacctgctgttataactcagagtccatatttg

SEQ ID NO: 58 - DNA, 69 bp, Homo sapiens
agctgagtcccatcgatgttgaatctcatgccactgcaagtgccattcaccactgcgtcctgggcttta

SEQ ID NO: 59 - DNA, 69 bp, Homo sapiens
tccagagaaaatcgaagaagtcctgtcacctgaaggctccccttcaaaatcgccatccaagaaaaagaa

SEQ ID NO: 60 - DNA, 69 bp, Homo sapiens
tgtttaagtccctgcttttatcctggtgcctgattggggtggggactgtcctactgtaacccctgtgaa

SEQ ID NO: 61 - DNA, 69 bp, Homo sapiens
agtgacaggcacttagatgcagcatttcaccactcatgctactaatcatctacctgctactactgtaaa

SEQ ID NO: 62 - DNA, 69 bp, Homo sapiens
tgtcataatagaaaacacaagcatttgaccaaatgagatccattcagcgactaactggcaaggcactca

SEQ ID NO: 63 - DNA, 69 bp, Homo sapiens
atacttctgcctcacttcgagcagacttttgttctcggcgctcctcacgatggagtttcatgcttcatt

SEQ ID NO: 64 - DNA, 69 bp, Homo sapiens
gctggactccataccacatttttggagtcctgtcattgcttactgacccagaaactcccttggggaaaa

SEQ ID NO: 65 - DNA, 70 bp, Homo sapiens
ggttctgtacgaggacgagccactgaaggaatactacaccctcatggacatcgcctacatctacccctgg

SEQ ID NO: 66 - DNA, 69 bp, Homo sapiens
tgatagaggcagcacccgagtcccagatgatgccagcaagcgtcttaactgggaacgttatcatagaaa

SEQ ID NO: 67 - DNA, 69 bp, Homo sapiens
cttttcttcaagcctgccatcaaggacatttcttaagacccaactggcatgagttggggtaatttccta

SEQ ID NO: 68 - DNA, 70 bp, Homo sapiens
cctccattctgtgcgttctgttcctctgcacagctctcattgccaactgtttctggaggatctatgcaga

SEQ ID NO: 69 - DNA, 69 bp, Homo sapiens
gcccagtttccttatcacttgctgtagatggcttattttgcattcatgcagactatgttgcaagtctgt

SEQ ID NO: 70 - DNA, 70 bp, Homo sapiens
ctggaacgcacgccctcgccggagcctgttgacaaggacttctactccgagtttgggaacaagaccacag

SEQ ID NO: 71 - DNA, 69 bp, Homo sapiens
caccatctcccttctcatctagaataaaccaggcctctggctaccacttggacctttattgcccttcct

SEQ ID NO: 72 - DNA, 70 bp, Homo sapiens
gagtatctattatagtgggagcacctactacaacccgtccctcaagagtcgagtcaccatatccgtagac

SEQ ID NO: 73 - DNA, 70 bp, Homo sapiens
agttgtgacgtgcagtctaatgaagactaccctcggaggcccctaaccagggccaggagcagactgtccc

SEQ ID NO: 74 - DNA, 69 bp, Homo sapiens
ctcattgtcctgagccttcccgtggcaagaaagggatccatatcggatttgttgtatatggcttggttg

SEQ ID NO: 75 - DNA, 69 bp, Homo sapiens
gatttgcagtaccacacttttggtctttaagcctgacctgttagacaaccatccaaggctggtgacttt

SEQ ID NO: 76 - DNA, 70 bp, Homo sapiens
gatgagctcttttaactcaagcgaaacttcaaggccagaagatcttgcctgttggtgatcatgctcctca

SEQ ID NO: 77 - DNA, 69 bp, Homo sapiens
tggttgcggccagcacccgggagatggcgatgctcatagctcaggccttacagacgattaactatgggc

SEQ ID NO: 78 - DNA, 69 bp, Homo sapiens
tccatgtgaaaggttctttgcaagaggaaagccttagggacaagattcccgaagaggacaggcgcaaaa

SEQ ID NO: 79 - DNA, 69 bp, Homo sapiens
acacagccgagcagcatttccgttgaaggacttgcatccccattgcgggcagtgctggacgtgtcccgg

SEQ ID NO: 80 - DNA, 69 bp, Homo sapiens
ctgcagggacaccagcaatatcaacgacgacaactgtggaaatccgcaaaagcagtgttatgacaactg

SEQ ID NO: 81 - DNA, 50 bp, Homo sapiens
cctgctactctcccatgtcatcttcaacccttcctcagaagcccccttac

SEQ ID NO: 82 - DNA, 69 bp, Homo sapiens
gttctacccgacgcttctaccctcatacccacaatatggatgggttcttcattgccaagttcaagaaat

SEQ ID NO: 83 - DNA, 69 bp, Homo sapiens
aagctgatagccagacacgttctgatttctgcccttgttccagctttgacgtattatctgttgccttat

SEQ ID NO: 84 - DNA, 69 bp, Homo sapiens
actactctctcctttacctttacctttaccacagtgcagggctgactgaactgtcactgtgagatattt

SEQ ID NO: 85 - DNA, 70 bp, Homo sapiens
catcgctgccaacagctaaagcccccggtccctctgcagtctctataccaataaagtggccctgctctca

SEQ ID NO: 86 - DNA, 70 bp, Homo sapiens
gtgtctttgagggattctaccctgaacatacctcacagatcctccctgtcatgccacatttcactgattg

SEQ ID NO: 87 - DNA, 69 bp, Homo sapiens
ttagatgactgcccaagggactctggttgctatatctcatcaggaaattcagataatggcaaagaggat

SEQ ID NO: 88 - DNA, 69 bp, Homo sapiens
cactgcccctaagctggggtggaaccggaatttgggtcaatacatccttttgtctcccaagggaagaga

SEQ ID NO: 89 - DNA, 70 bp, Homo sapiens
gcaaaagtattctgaactgtcaagctgcccagtcagatgggctgttgccatttaaaatcactgtaattaa

SEQ ID NO: 90 - DNA, 69 bp, Homo sapiens
aacctttttcattcaacattgtagggggcaagctttggtgcgccccctgctgaggagcagccccaggag

SEQ ID NO: 91 - DNA, 69 bp, Homo sapiens
gagctccctgcaagtgtaaatattaaggatgacctgtgcaaaattatacccacaccagcactagtggta

SEQ ID NO: 92 - DNA, 70 bp, Homo sapiens
taacctaattagagaagcgattgcactcgagtccccacagctggcagtggtgttacagatggaaccagcc

SEQ ID NO: 93 - DNA, 69 bp, Homo sapiens
acctagacgcatgctttccagacagggcgttttggctgcatcacagccactggctggtcctattcattt

SEQ ID NO: 94 - DNA, 69 bp, Homo sapiens
ctgtctgctaactccagacctcccagcttgaagccaaatctttccatgtgagattgatatggatttcct

SEQ ID NO: 95 - protein, 894 aa, Homo sapiens
MAWRCPRMGRVPLAWCLALCGWACMAPRGTQAEESPFVGNPGNITGARGLTGTLRCQLQVQGEPPEVHWLRDGQILELADSTQTQVPLGEDEQDDWIVVSQLRITSLQLSDTGQYQCLVFLGHQTFVSQPGYVGLEGLPYFLEEPEDRTVAANTPFNLSCQAQGPPEPVDLLWLQDAVPLATAPGHGPQRSLHVPGLNKTSSFSCEAHNAKGVTTSRTATITVLPQQPRNLHLVSRQPTELEVAWTPGLSGIYPLTHCTLQAVLSDDGMGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPGQAQPVHQLVKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 96 - protein, 181 aa, Homo sapiens
MGDIFKNNGVLQGRLRAVACAPHRFGPRLRCLHHDQGLTELAWGTWPHSHPVRHQPQMPSARECCSIVCMAAKEVSAPKAPGSPWMVPGDVAMSGHRVGALDERGHPNPQTGHCRGGSVSVTWSSVSCCRGRLAAVRVMIARDPSTCHLAKGCSPAWGFLPQARGPAGTRTPQRRCSSHEA

SEQ ID NO: 97 - protein, 1053 aa, Homo sapiens
MSSEESYRAILRYLTNEREPYAPGTEGNVKRKIRKAAACYVVRGGTLYYQRRQRHRKTFAELEVVLQPERRRDLIEAAHLGPGGTHHTRHQTWHYLSKTYWWRGILKQVKDYIKQCSKCQEKLDRSRPISDVSEMLEELGLDLESGEESNESEDDLSNFTSSPTTASKPAKKKPVSKHELVFVDTKGVVKRSSPKHCQAVLKQLNEQRLSNQFCDVTLLIEGEEYKAHKSVLSANSEYFRDLFIEKGAVSSHEAVVDLSGFCKASFLPLLEFAYTSVLSFDFCSMADVAILARHLFMSEVLEICESVHKLMEEKQLTVYKKGEVQTVASTQDLRVQNGGTAPPVASSEGTTTSLPTELGDCEIVLLVNGELPEAEQNGEVGRQPEPQVSSEAESALSSVGCIADSHPEMESVDLITKNNQTELETSNNRENNTVSNIHPKLSKENVISSSPEDSGMGNDISAEDICAEDIPKHRQKVDQPLKDQENLVASTAKTNFGPDDDTYRSRLRQRSVNEGAYIRLHKGMEKKLQKRKAVPKSAVQQVAQKLVQRGKKMKQPKRDAKENTEEASHKCGECGMVFQRRYALIMHKLKHERARDYKCPLCKKQFQYSASLRAHLIRHTRKDAPSSSSSNSTSNEASGTSSEKGRTKREFICSICGRTLPKLYSLRIHMLKHTGVKPHACQVCGKTFIYKHGLKLHQSLHQSQKQFQCELCVKSFVTKRSLQEHMSIHTGESKYLCSVCGKSFHRGSGLSKHFKKHQPKPEVRGYHCTQCEKSFFEARDLRQHMNKHLGVKPFQCQFCDKCYSWKKDWYSHVKSHSVTEPYRCNICGKEFYEKALFRRHVKKATHGKKGRAKQNLERVCEKCGRKFTQLREYRRHMNNHEGVKPFECLTCGVAWADARSLKRHVRTHTGERPYVCPVCSEAYIDARTLRKHMTKFHRDYVPCKIMLEKDTLQFHNQGTQVAHAVSILTAGMQEQESSGPQELETVVVTGETMEALEAVAATEEYPSVSTLSDQSIMQVVNYVLAQQQGQKLSEVAEAIQTVKVEVAHISGGE

SEQ ID NO: 98 - protein, 283 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPRGDVVKVIVSVQRKRQEAEGEATVIEALQAPPDVTTVAVEETIPSFTGRSPNH

SEQ ID NO: 99 - protein, 429 aa, Homo sapiens
MGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPR

SEQ ID NO: 100 - protein, 3664 aa, Homo sapiens
MVRETRHLWVGNLPENVREEKIIEHFKRYGRVESVKILPKRGSEGGVAAFVDFVDIKSAQKAHNSVNKMGDRDLRTDYNEPGTIPSAARGLDDTVSIASRSREVSGFRGGGGGPAYGPPPSLHAREGRYERRLDGASDNRERAYEHSAYGHHERGTGGFDRTRHYDQDYYRDPRERTLQHGLYYASRSRSPNRFDAHDPRYEPRAREQFTLPSVVHRDIYRDDITREVRGRRPERNYQHSRSRSPHSSQSRNQSPQRLASQASRPTRSPSGSGSRSRSSSSDSISSSSSTSSDSSDSSSSSSDDSPARSVQSAAVPAPTSQLLSSLEKDEPRKSFGIKVQNLPVRSTDTSLKDGLFHEFKKFGKVTSVQIHGTSEERYGLVFFRQQEDQEKALTASKGKLFFGMQIEVTAWIGPETESENEFRPLDERIDEFHPKATRTLFIGNLEKTTTYHDLRNIFQRFGEIVDIDIKKVNGVPQYAFLQYCDIASVCKAIKKMDGEYLGNNRLKLGFGKSMPTNCVWLDGLSSNVSDQYLTRHFCRYGPVVKVVFDRLKGMALVLYNEIEYAQAAVKETKGRKIGGNKIKVDFANRESQLAFYHCMEKSGQDIRDFYEMLAERREERRASYDYNQDRTYYESVRTPGTYPEDSRRDYPARGREFYSEWETYQGDYYESRYYDDPREYRDYRNDPYEQDIREYSYRQRERERERERFESDRDRDHERRPIERSQSPVHLRRPQSPGASPSQAERLPSDSERRLYSRSSDRSGSCSSLSPPRYEKLDKSRLERYTKNEKTDKERTFDPERVERERRLIRKEKVEKDKTDKQKRKGKVHSPSSQSSETDQENEREQSPEKPRSCNKLSREKADKEGIAKNRLELMPCVVLTRVKEKEGKVIDHTPVEKLKAKLDNDTVKSSALDQKLQVSQTEPAKSDLSKLESVRMKVPKEKGLSSHVEVVEKEGRLKARKHLKPEQPADGVSAVDLEKLEARKRRFADSNLKAEKQKPEVKKSSPEMEDARVLSKKQPDVSSREVILLREGEAERKPVRKEILKRESKKIKLDRLNTVASPKDCQELASISVGSGSRPSSDLQARLGELAGESVENQEVQSKKPIPSKPQLKQLQVLDDQGPEREDVRKNYCSLRDETPERKSGQEKSHSVNTEEKIGIDIDHTQSYRKQMEQSRRKQQMEMEIAKSEKFGSPKKDVDEYERRSLVHEVGKPPQDVTDDSPPSKKKRMDHVDFDICTKRERNYRSSRQISEDSERTGGSPSVRHGSFHEDEDPIGSPRLLSVKGSPKVDEKVLPYSNITVREESLKFNPYDSSRREQMADMAKIKLSVLNSEDELNRWDSQMKQDAGRFDVSFPNSIIKRDSLRKRSVRDLEPGEVPSDSDEDGEHKSHSPRASALYESSRLSFLLRDREDKLRERDERLSSSLERNKFYSFALDKTITPDTKALLERAKSLSSSREENWSFLDWDSRFANFRNNKDKEKVDSAPRPIPSWYMKKKKIRTDSEGKMDDKKEDHKEEEQERQELFASRFLHSSIFEQDSKRLQHLERKEEDSDFISGRIYGKQTSEGANSTTDSIQEPVVLFHSRFMELTRMQQKEKEKDQKPKEVEKQEDTENHPKTPESAPENKDSELKTPPSVGPPSVTVVTLESAPSALEKTTGDKTVEAPLVTEEKTVEPATVSEEAKPASEPAPAPVEQLEQVDLPPGADPDKEAAMMPAGVEEGSSGDQPPYLDAKPPTPGASFSQAESNVDPEPDSTQPLSKPAQKSEEANEPKAEKPDATADAEPDANQKAEAAPESQPPASEDLEVDPPVAAKDKKPNKSKRSKTPVQAAAVSIVEKPVTRKSERIDREKLKRSNSPRGEAQKLLELKMEAEKITRTASKNSAADLEHPEPSLPLSRTRRRNVRSVYATMGDHENRSPVKEPVEQPRVTRKRLERELQEAAAVPTTPRRGRPPKTRRRADEEEENEAKEPAETLKPPEGWRSPRSQKTAAGGGPQGKKGKNEPKVDATRPEATTEVGPQIGVKESSMEPKAAEEEAGSEQKRDRKDAGTDKNPPETAPVEVVEKKPAPEKNSKSKRGRSRNSRLAVDKSASLKNVDAAVSPRGAAAQAGERESGVVAVSPEKSESPQKEDGLSSQLKSDPVDPDKEPEKEDVSASGPSPEATQLAKQMELEQAVEHIAKLAEASASAAYKADAPEGLAPEDRDKPAHQASETELAAAIGSIINDISGEPENFPAPPPYPGESQTDLQPPAGAQALQPSEEGMETDEAVSGILETEAATESSRPPVNAPDPSAGPTDTKEARGNSSETSHSVPEAKGSKEVEVTLVRKDKGRQKTTRSRRKRNTNKKVVAPVESHVPESNQAQGESPAANEGTTVQHPEAPQEEKQSEKPHSTPPQSCTSDLSKIPSTENSSQEISVEERTPTKASVPPDLPPPPQPAPVDEEPQARFRVHSIIESDPVTPPSDPSIPIPTLPSVTAAKLSPPVASGGIPHQSPPTKVTEWITRQEEPRAQSTPSPALPPDTKASDVDTSSSTLRKILMDPKYVSATSVTSTSVTTAIAEPVSAAPCLHEAPPPPVDSKKPLEEKTAPPVTNNSEIQASEVLVAADKEKVAPVIAPKITSVISRMPVSIDLENSQKITLAKPAPQTLTGLVSALTGLVNVSLVPVNALKGPVKGSVTTLKSLVSTPAGPVNVLKGPVNVLTGPVNVLTTPVNATVGTVNAAPGTVNAAASAVNATASAVTVTAGAVTAASGGVTATTGTVTMAGAVIAPSTKCKQRASANENSRFHPGSMPVIDDRPADAGSGAGLRVNTSEGVVLLSYSGQKTEGPQRISAKISQIPPASAMDIEFQQSVSKSQVKPDSVTASQPPSKGPQAPAGYANVATHSTLVLTAQTYNASPVISSVKADRPSLEKPEPIHLSVSTPVTQGGTVKVLTQGINTPPVLVHNQLVLTPSIVTTNKKLADPVTLKIETKVLQPANLGSTLTPHHPPALPSKLPTEVNHVPSGPSIPADRTVSHLAAAKLDAHSPRPSGPGPSSFPRASHPSSTASTALSTNATVMLAAGIPVPQFISSIHPEQSVIMPPHSITQTVSLSHLSQGEVRMNTPTLPSITYSIRPEALHSPRAPLQPQQIEVRAPQRASTPQPAPAGVPALASQHPPEEEVHYHLPVARATAPVQSEVLVMQSEYRLHPYTVPRDVRIMVHPHVTAVSEQPRAADGVVKVPPASKAPQQPGKEAAKTPDAKAAPTPTPAPVPVPVPLPAPAPAPHGEARILTVTPSNQLQGLPLTPPVVVTHGVQIVHSSGELFQEYRYGDIRTYHPPAQLTHTQFPAASSVGLPSRTKTAAQGPPPEGEPLQPPQPVQSTQPAQPAPPCPPSQLGQPGQPPSSKMPQVSQEAKGTQTGVEQPRLPAGPANRPPEPHTQVQRAQAETGPTSFPSPVSVSMKPDLPVSLPTQTAPKQPLFVPTTSGPSTPPGLVLPHTEFQPAPKQDSSPHLTSQRPVDMVQLLKKYPIVWQGLLALKNDTAAVQLHFVSGNNVLAHRSLPLSEGGPPLRIAQRMRLEATQLEGVARRMTVETDYCLLLALPCGRDQEDVVSQTESLKAAFITYLQAKQAAGIINVPNPGSNQPAYVLQIFPPCEFSESHLSRLAPDLLASISNISPHLMIVIASV

SEQ ID NO: 101 - protein, 1256 aa, Homo sapiens
MPGPRGAAGGLAPEMRGAGAAGLLALLLLLLLLLLGLGGRVEGGPAGERGAGGGGALARERFKVVFAPVICKRTCLKGQCRDSCQQGSNMTLIGENGHSTDTLTGSGFRVVVCPLPCMNGGQCSSRNQCLCPPDFTGRFCQVPAGGAGGGTGGSGPGLSRTGALSTGALPPLAPEGDSVASKHAIYAVQVIADPPGPGEGPPAQHAAFLVPLGPGQISAEVQAPPPVVNVRVHHPPEASVQVHRIESSNAESAAPSQHLLPHPKPSHPRPPTQKPLGRCFQDTLPKQPCGSNPLPGLTKQEDCCGSIGTAWGQSKCHKCPQLQYTGVQKPGPVRGEVGADCPQGYKRLNSTHCQDINECAMPGVCRHGDCLNNPGSYRCVCPPGHSLGPSRTQCIADKPEEKSLCFRLVSPEHQCQHPLTTRLTRQLCCCSVGKAWGARCQRCPTDGTAAFKEICPAGKGYHILTSHQTLTIQGESDFSLFLHPDGPPKPQQLPESPSQAPPPEDTEEERGVTTDSPVSEERSVQQSHPTATTTPARPYPELISRPSPPTMRWFLPDLPPSRSAVEIAPTQVTETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLDVDECEAGDVCDNGICSNTPGSFQCQCLSGYHLSRDRSHCEDIDECDFPAACIGGDCINTNGSYRCLCPQGHRLVGGRKCQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 102 - protein, 233 aa, Homo sapiens
MEGGAYGAGKAGGAFDPYTLVRQPHTILRVVSWLFSIVVFGSIVNEGYLNSASEGEEFCIYNRNPNACSYGVAVGVLAFLTCLLYLALDVYFPQISSVKDRKKAVLSDIGVSAFWAFLWFVGFCYLANQWQVSKPKDNPLNEGTDAARAAIAFSFFSIFTWAGQAVLAFQRYQIGADSALFSQDYMDPSQDSSMPYAPYVEPTGPDPAGMGGTYQQPANTFDTEPQGYQSQGY

SEQ ID NO: 103 - protein, 182 aa, Homo sapiens
MGLLSILRKLKSAPDQEVRILLLGLDNAGKTTLLKQLASEDISHITPTQGFNIKSVQSQGFKLNVWDIGGQRKIRPYWKNYFENTDILIYVIDSADRKRFEETGQELAELLEEEKLSCVPVLIFANKQDLLTAAPASEIAEGLNLHTIRDRVWQIQSCSALTGEGVQDGMNWVCKNVNAKKK

SEQ ID NO: 104 - protein, 595 aa, Homo sapiens
MKFFSYILVYRRFLFVVFTVLVLLPLPIVLHTKEAECAYTLFVVATFWLTEALPLSVTALLPSLMLPMFGIMPSKKVASAYFKDFHLLLIGVICLATSIEKWNLHKRIALKMVMMVGVNPAWLTLGFMSSTAFLSMWLSNTSTAAMVMPIAEAVVQQIINAEAEVEATQMTYFNGSTNHGLEIDESVNGHEINERKEKTKPVPGYNNDTGKISSKVELEKNSGMRTKYRTKKGHVTRKLTCLCIAYSSTIGGLTTITGTSTNLIFAEYFNTRYPDCRCLNFGSWFTFSFPAALIILLLSWIWLQWLFLGFNFKEMFKCGKTKTVQQKACAEVIKQEYQKLGPIRYQEIVTLVLFIIMALLWFSRDPGFVPGWSALFSEYPGFATDSTVALLIGLLFFLIPAKTLTKTTPTGEIVAFDYSPLITWKEFQSFMPWDIAILVGGGFALADGCEESGLSKWIGNKLSPLGSLPAWLIILISSLMVTSLTEVASNPATITLFLPILSPLAEAIHVNPLYILIPSTLCTSFAFLLPVANPPNAIVFSYGHLKVIDMVKAGLGVNIVGVAVVMLGICTWIVPMFDLYTYPSWAPAMSNETMP

SEQ ID NO: 105 - protein, 914 aa, Homo sapiens
MVQRMWAEAAGPAGGAEPLFPGSRRSRSVWDAVRLEVGVPDSCPVVLHSFTQLDPDLPRPESSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGRCDALTASSRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 106 - protein, 674 aa, Homo sapiens
MSSDASQGVITTPPPPSMPHKERYFDRINENDPEYIRERNMSPDLRQDFNMMEQRKRVTQILQSPAFREDLECLIQEQMKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSTNLKIDHTGFSPHAAIYSTRPDVKCVIHIHTLATAAVSSMKCGILPISQESLLLGDVAYYDYQGSLEEQEERIQLQKVLGPSCKVLVLRNHGVVALGETLEEAFHYIFNVQLACEIQVQALAGAGGVDNLHVLDFQKYKAFTYTVAASGGGGVNMGSHQKWKVGEIEFEGLMRTLDNLGYRTGYAYRHPLIREKPRHKSDVEIPATVTAFSFEDDTVPLSPLKYMAQRQQREKTRWLNSPNTYMKVNVPEESRNGETSPRTKITWMKAEDSSKVSGGTPIKIEDPNQFVPLNTNPNEVLEKRNKIREQNRYDLKTAGPQSQLLAGIVVDKPPSTMQFEDDDHGPPAPPNPFSHLTEGELEEYKRTIERKQQGLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 107 - protein, 859 aa, Homo sapiens
MACLHETRTPSPSFGGFVSTLSEASMRKLDPDTSDCTPEKDLTPTHVLQLHEQDAGGPGGAAGSPESRASRVRADEVRLQCQSGSGFLEGLFGCLRPVWTMIGKAYSTEHKQQQEDLWEVPFEEILDLQWVGSGAQGAVFLGRFHGEEVAVKKVRDLKETDIKHLRKLKHPNIITFKGVCTQAPCYCILMEFCAQGQLYEVLRAGRPVTPSLLVDWSMGIAGGMNYLHLHKIIHRDLKSPNMLITYDDVVKISDFGTSKELSDKSTKMSFAGTVAWMAPEVIRNEPVSEKVDIWSFGVVLWELLTGEIPYKDVDSSAIIWGVGSNSLHLPVPSSCPDGFKILLRQCWNSKPRNRPSFRQILLHLDIASADVLSTPQETYFKSQAEWREEVKLHFEKIKSEGTCLHRLEEELVMRRREELRHALDIREHYERKLERANNLYMELNALMLQLELKERELLRREQALERRCPGLLKPHPSRGLLHGNTMEKLIKKRNVPQKLSPHSKRPDILKTESLLPKLDAALSGVGLPGCPKAPPSPGRSRRGKTRHRKASAKGSCGDLPGLRTAVPPHEPGGPGSPGGLGGGPSAWEACPPALRGLHHDLLLRKMSSSSPDLLSAALGSRGRGATGGAGDPGSPPPARGDTPPSEGSAPGSTSPDSPGGAKGEPPPPVGPGEGVGLLGTGREGTSGRGGSRAGSQHLTPAALLYRAAVTRSQKRGISSEEEEGEVDSEVELTSSQRWPQSLNMRQSLSTFSSENPSDGEEGTASEPSPSGTPEVGSTNTDERPDERSDDMCSQGSEIPLDPPPSEVIPGPEPSSLPIPHQELLRERGPPNSEDSDCDSTELDNSNSVDALRPPASLPP

SEQ ID NO: 108 - protein, 147 aa, Homo sapiens
MGTPASVVSEPPPWQAPIEARGRKQASANIFQDAELLQIQGLFQRSGDQLAEERAQIIWECAGDHRVAEALKRLRRKRPPRQKPLGHSLHHCSRLRILEPHSALANPQSATETASSEQYLHSRKKSARIRRNWRKSGPTSYLHQIRH

SEQ ID NO: 109 - protein, 292 aa, Homo sapiens
MEEEEYEQIPQENPPEELSQDPVLELSGGLREKEQKTPRRLRLILMGKTGSGKSATGNSILGRDVFESKLSTRPVTKTSQRRSREWAGKELEVIDTPNILSPQVSPEVADAICQAIVLSAPGPHAVLLVTQLGRFTDEDQQVVRRLQEVFGVGVLGHTILVFTRKEDLAGGSLEDYVRETNNQALAWLDVTLARRHCGFNNRAQGEEQEAQLRELMEKVEAIMWENEGDYYSNKAYQYTQQNFRLKELQERQVSQGQGSEDVPGEESWLEGLSQIQKESEEAHRCLLGKADL

SEQ ID NO: 110 - protein, 132 aa, Homo sapiens
MGIVANFQELAVPVVHDGGALLAFVCGVVYTLLQSIISYKSCPQWNSLSTCHIRMVISAVSCAAVIPMIVCASLISITKLEWNPREKDYVYHVVSAICEWTVAFGFIFYFLTFIQDFQSVTLRISTEINGDI

SEQ ID NO: 111 - protein, 482 aa, Homo sapiens
MASFSAETNSTDLLSQPWNEPPVILSMVILSLTFLLGLPGNGLVLWVAGLKMQRTVNTIWFLHLTLADLLCCLSLPFSLAHLALQGQWPYGRFLCKLIPSIIVLNMFASVFLLTAISLDRCLVVFKPIWCQNHRNVGMACSICGCIWVVAFVMCIPVFVYREIFTTDNHNRCGYKFGLSSSLDYPDFYGDPLENRSLENIVQPPGEMNDRLDPSSFQTNDHPWTVPTVFQPQTFQRPSADSLPRGSARLTSQNLYSNVFKPADVVSPKIPSGFPIEDHETSPLDNSDAFLSTHLKLFPSASSNSFYESELPQGFQDYYNLGQFTDDDQVPTPLVAITITRLVVGFLLPSVIMIACYSFIVFRMQRGRFAKSQSKTFRVAVVVVAVFLVCWTPYHIFGVLSLLTDPETPLGKTLMSWDHVCIALASANSCFNPFLYALLGKDFRKKARQSIQGILEAAFSEELTRSTHCPSNNVISERNSTTV

SEQ ID NO: 112 - protein, 344 aa, Homo sapiens
MHRTTRIKITELNPHLMCALCGGYFIDATTIVECLHSFCKTCIVRYLETNKYCPMCDVQVHKTRPLLSIRSDKTLQDIVYKLVPGLFKDEMKRRRDFYAAYPLTEVPNGSNEDRGEVLEQEKGALSDDEIVSLSIEFYEGARDRDEKKGPLENGDGDKEKTGVRFLRCPAAMTVMHLAKFLRNKMDVPSKYKVEVLYEDEPLKEYYTLMDIAYIYPWRRNGPLPLKYRVQPACKRLTLATVPTPSEGTNTSGASECESVSDKAPSPATLPATSSSLPSPATPSHGSPSSHGPPATHPTSPTPPSTASGATTAANGGSLNCLQTPSSTSRGRKMTVNGAPVPPLT

SEQ ID NO: 113 - protein, 150 aa, Homo sapiens
MSAKDERAREILRGFKLNWMNLRDAETGKILWQGTEDLSVPGVEHEARVPKKILKCKAVSRELNFSSTEQMEKFRLEQKVYFKGQCLEEWFFEFGFVIPNSTNTWQSLIEAAPESQMMPASVLTGNVIIETKFFDDDLLVSTSRVRLFYV

SEQ ID NO: 114 - protein, 1252 aa, Homo sapiens
MSTTVNVDSLAEYEKSQIKRALELGTVMTVFSFRKSTPERRTVQVIMETRQVAWSKTADKIEGFLDIMEIKEIRPGKNSKDFERAKAVRQKEDCCFTILYGTQFVLSTLSLAADSKEDAVNWLSGLKILHQEAMNASTPTIIESWLRKQIYSVDQTRRNSISLRELKTILPLINFKVSSAKFLKDKFVEIGAHKDELSFEQFHLFYKKLMFEQQKSILDEFKKDSSVFILGNTDRPDASAVYLHDFQRFLIHEQQEHWAQDLNKVRERMTKFIDDTMRETAEPFLFVDEFLTYLFSRENSIWDEKYDAVDMQDMNNPLSHYWISSSHNTYLTGDQLRSESSPEAYIRCLRMGCRCIELDCWDGPDGKPVIYHGWTRTTKIKFDDVVQAIKDHAFVTSSFPVILSIEEHCSVEQQRHMAKAFKEVFGDLLLTKPTEASADQLPSPSQLREKIIIKHKKLGPRGDVDVNMEDKKDEHKQQGELYMWDSIDQKWTRHYCAIADAKLSFSDDIEQTMEEEVPQDIPPTELHFGEKWFHKKVEKRTSAEKLLQEYCMETGGKDGTFLVRESETFPNDYTLSFWRSGRVQHCRIRSTMEGGTLKYYLTDNLRFRRMYALIQHYRETHLPCAEFELRLTDPVPNPNPHESKPWYYDSLSRGEAEDMLMRIPRDGAFLIRKREGSDSYAITFRARGKVKHCRINRDGRHFVLGTSAYFESLVELVSYYEKHSLYRKMRLRYPVTPELLERYNTERDINSLYDVSRMYVDPSEINPSMPQRTVKALYDYKAKRSDELSFCRGALIHNVSKEPGGWWKGDYGTRIQQYFPSNYVEDISTADFEELEKQIIEDNPLGSLCRGILDLNTYNVVKAPQGKNQKSFVFILEPKEQGDPPVEFATDRVEELFEWFQSIREITWKIDSKENNMKYWEKNQSIAIELSDLVVYCKPTSKTKDNLENPDFREIRSFVETKADSIIRQKPVDLLKYNQKGLTRVYPKGQRVDSSNYDPFRLWLCGSQMVALNFQTADKYMQMNHALFSLNGRTGYVLQPESMRTEKYDPMPPESQRKILMTLTVKVLGARHLPKLGRSIACPFVEVEICGAEYGNNKFKTTVVNDNGLSPIWAPTQEKVTFEIYDPNLAFLRFVVYEEDMFSDPNFLAHATYPIKAVKSGFRSVPLKNGYSEDIELASLLVFCEMRPVLESEEELYSSCRQLRRRQEELNNQLFLYDTHQNLRNANRDALVKEFSVNENHSSCTRRNATRG

SEQ ID NO: 115 - protein, 347 aa, Homo sapiens
MGDELAPCPVGTTAWPALIQLISKTPCMPQAASNTSLGLGDLRVPSSMLYWLFLPSSLLAAATLAVSPLLLVTILRNQRLRQEPHYLLPANILLSDLAYILLHMLISSSSLGGWELGRMACGILTDAVFAACTSTILSFTAIVLHTYLAVIHPLRYLSFMSHGAAWKAVALIWLVACCFPTFLIWLSKWQDAQLEEQGASYILPPSMGTQPGCGLLVIVTYTSILCVLFLCTALIANCFWRIYAEAKTSGIWGQGYSRARGTLLIHSVLITLYVSTGVVFSLDMVLTRYHHIDSGTHTWLLAANSEVLMMLPRAMLPYLYLLRYRQLLGMVRGHLPSRRHQAIFTIS

SEQ ID NO: 116 - protein, 175 aa, Homo sapiens
MGKVLSKIFGNKEMRILMLGLDAAGKTTILYKLKLGQSVTTIPTVGFNVETVTYKNVKFNVWDVGGQDKIRPLWRHYYTGTQGLIFVVDCADRDRIDEARQELHRIINDREMRDAIILIFANKQDLPDAMKPHEIQEKLGLTRIRDRNWYVQPSCATSGDGLYEGLTWLTSNYKS

SEQ ID NO: 117 - protein, 1504 aa, Homo sapiens
MATARTFGPEREAEPAKEARVVGSELVDTYTVYIIQVTDGSHEWTVKHRYSDFHDLHEKLVAERKIDKNLLPPKKIIGKNSRSLVEKREKDLEVYLQKLLAAFPGVTPRVLAHFLHFHFYEINGITAALAEELFEKGEQLLGAGEVFAIGPLQLYAVTEQLQQGKPTCASGDAKTDLGHILDFTCRLKYLKVSGTEGPFGTSNIQEQLLPFDLSIFKSLHQVEISHCDAKHIRGLVASKPTLATLSVRFSATSMKEVLVPEASEFDEWEPEGTTLEGPVTAVIPTWQALTTLDLSHNSISEIDESVKLIPKIEFLDLSHNGLLVVDNLQHLYNLVHLDLSYNKLSSLEGLHTKLGNIKTLNLAGNLLESLSGLHKLYSLVNLDLRDNRIEQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGIMFVQEEALASSLSSTDSLTPEHQPIAQGCSDSLESIPAGQAASDDLRDVPGAVGGASPEHAEPEVQVVPGSGQIIFLPFTCIGYTATNQDFIQRLSTLIRQAIERQLPAWIEAANQREEGQGEQGEEEDEEEEEEEDVAENRYFEMGPPDVEEEEGGGQGEEEEEEEEDEEAEEERLALEWALGADEDFLLEHIRILKVLWCFLIHVQGSIRQFAACLVLTDFGIAVFEIPHQESRGSSQHILSSLRFVFCFPHGDLTEFGFLMPELCLVLKVRHSENTLFIISDAANLHEFHADLRSCFAPQHMAMLCSPILYGSHTSLQEFLRQLLTFYKVAGGCQERSQGCFPVYLVYSDKRMVQTAAGDYSGNIEWASCTLCSAVRRSCCAPSEAVKSAAIPYWLLLTPQHLNVIKADFNPMPNRGTHNCRNRNSFKLSRVPLSTVLLDPTRSCTQPRGAFADGHVLELLVGYRFVTAIFVLPHEKFHFLRVYNQLRASLQDLKTVVIAKTPGTGGSPQGSFADGQPAERRASNDQRPQEVPAEALAPAPAEVPAPAPAAASASGPAKTPAPAEASTSALVPEETPVEAPAPPPAEAPAQYPSEHLIQATSEENQIPSHLPACPSLRHVASLRGSAIIELFHSSIAEVENEELRHLMWSSVVFYQTPGLEVTACVLLSTKAVYFVLHDGLRRYFSEPLQDFWHQKNTDYNNSPFHISQCFVLKLSDLQSVNVGLFDQHFRLTGSTPMQVVTCLTRDSYLTHCFLQHLMVVLSSLERTPSPEPVDKDFYSEFGNKTTGKMENYELIHSSRVKFTYPSEEEIGDLTFTVAQKMAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQALTLVFDDVQGHDLMGSVTLDHFGEVPGGPARASQGREVQWQVFVPSAESREKLISLLARQWEALCGRELPVELTG

SEQ ID NO: 118 - protein, 163 aa, Homo sapiens
MMLPLQGAQMLQMLEKSLRKSLPASLKVYGTVFHINHGNPFNLKAVVDKWPDFNTVVVCPQEQDMTDDLDHYTNTYQIYSKDPQNCQEFLGSPELINWKQHLQIQSSQPSLNEAIQNLAAIKSFKVKQTQRILYMAAETAKELTPFLLKSKILSPSGGKPKAM

SEQ ID NO: 119 - protein, 127 aa, Homo sapiens
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCASRRGYSSSWFNVVAWFDPWGQGTLVTVSS

SEQ ID NO: 120 - protein, 1188 aa, Homo sapiens
MGPRKKSVKTCIMNNEIPEEMTADETKDYMNQLSHEVLCHIFRYLPLQDIMCMECLSRKLKEAVTLYLRVVRVVDLCAGRWWEYMPSGFTDASFLTLLKKMPDVEQLYGLHPRYLERRRVRGHEAFSIPGVLEALQACPNLVGVETSHLELVESIWTYMPHVHILGKFRNRNGAFPIPPENKLKIPIGAKIQTLHLVGVNVPEIPCIPMLRHLYMKWVRLTKPQPFKDFLCISLRTFVMRNCAGPTNSLKYVPLVTGLASARNLEHLEMVRVPFLGGLIQHVVEDSWRSGGFRNLHTIVLGACKNALEVDLGYLIITAARRLHEVRIQPSLTKDGVFSALKMAELEFPQFETLHLGYVDEFLLQSRMANADLVKYGLADVVENPGIITDIGMKAVNEVFSCIKYLAIYNCPHLHNPYNWISDHSRWTRLVDINLVRCHALKLDSFGQFIELLPSLEFISLDQMFREPPKGCARVGLSAGTGIGVSSALVSNQNSNNDDNNAQNNNANIHDNNHHHPDDSDEENDFRQDLQPGEQQFAADALNEMEDIVQEDGEVVAESGNNTPAHSQAIIPVDVDEEQAGPSGLQRVVKPTSITVHDSESDDEEDSLELQEVWIPKNGTRRYSEREEKTGESVQSRELSVSGKGKTPLRKRYNSHQMGQSKQFPLEESSCEKGCQVTSEQIKADMKAARDIPEKKKNKDVYPSCSSTTASTVGNSSSHNTASQSPDFVRTVNSGGSSEPSPTEVDVSRQCACSPGGSEDSEAMEEGDAESSVCPRCCCHRPQESQRRTSRCSDEERPSTSRACVVNGPDGTRSAFSFRTLPQGGSSGPAHDERTNGSGSGATGEDRRGSSQPESCDVQSNEDYPRRPLTRARSRLSHVLLVSESEVAKTKPRHAMKRKRTADKSTSTSDPVIEDDHVQVLVLKSKNLVGVTMTNCGITDLVLKDCPKMMFIHATRCRVLKHLKVENAPIVNRFDYAQCKKLNMDQVLDQILRMPPERNRIIYLRPMQQVDTLTLEQKLFSGPYPYHICIIHEFSNPPNVRNKVRIRSWMDTIANINQELIKYEFFPEATRSEEDLKKYPKYPWGREIYTLEGVVDGAPYSMISDFPWLRSLRAAEPNSFARYDFEDDEESTIYAPRRKGQLSADICMETIGEEISEMRQMKKGVFQRVVAIFIHYCDVNGEPVEDDYI

SEQ ID NO: 121 - protein, 1099 aa, Homo sapiens
MSLNNSSNVFLDSVPSNTNRFQVSVINENHESSAAADDNTDPPHYEETSFGDEAQKRLRISFRPGNQECYDNFLHSGETAKTDASFHAYDSHTNTYYLQTFGHNTMDAVPKIEYYRNTGSISGPKVNRPSLLEIHEQLAKNVAVTPSSADRVANGDGIPGDEQAENKEDDQAGVVKFGWVKGVLVRCMLNIWGVMLFIRLSWIVGEAGIGLGVIIIGLSTIVTTITGMSTSAIATNGVVRGGGAYYLISRSLGPEFGGSIGLIFAFANAVAVAMYVVGFAETVVDLLKESDSMMVDPTNDIRIIGSITVVILLGISVAGMEWEAKAQVILLVILLIAIANFFIGTVIPSNNEKKSRGFFNYQASIFAENFGPRFTKGEGFFSVFAIFFPAATGILAGANISGDLEDPQDAIPRGTMLAIFITTVAYLGVAICVGACVVRDATGNMNDTIISGMNCNGSAACGLGYDFSRCRHEPCQYGLMNNFQVMSMVSGFGPLITAGIFSATLSSALASLVSAPKVFQALCKDNIYKALQFFAKGYGKNNEPLRGYILTFLIAMAFILIAELNTIAPIISNFFLASYALINFSCFHASYAKSPGWRPAYGIYNMWVSLFGAVLCCAVMFVINWWAAVITYVIEFFLYVYVTCKKPDVNWGSSTQALSYVSALDNALELTTVEDHVKNFRPQCIVLTGGPMTRPALLDITHAFTKNSGLCICCEVFVGPRKLCVKEMNSGMAKKQAWLIKNKIKAFYAAVAADCFRDGVRSLLQASGLGRMKPNTLVIGYKKNWRKAPLTEIENYVGIIHDAFDFEIGVVIVRISQGFDISQVLQVQEELERLEQERLALEATIKDNECEEESGGIRGLFKKAGKLNITKTTPKKDGSINTSQSMHVGEFNQKLVEASTQFKKKQEKGTIDVWWLFDDGGLTLLIPYILTLRKKWKDCKLRIYVGGKINRIEEEKIAMASLLSKFRIKFADIHIIGDINIRPNKESWKVFEEMIEPYRLHESCKDLTTAEKLKRETPWKITDAELEAVKEKSYRQVRLNELLQEHSRAANLIVLSLPVARKGSISDLLYMAWLEILTKNLPPVLLVRGNHKNVLTFYS

SEQ ID NO: 122 - protein, 199 aa, Homo sapiens
MPNYKLTYFNMRGRAEIIRYIFAYLDIQYEDHRIEQADWPEIKSTLPFGKIPILEVDGLTLHQSLAIARYLTKNTDLAGNTEMEQCHVDAIVDTLDDFMSCFPWAEKKQDVKEQMFNELLTYNAPHLMQDLDTYLGGREWLIGNSVTWADFYWEICSTTLLVFKPDLLDNHPRLVTLRKKVQAIPAVANWIKRRPQTKL

SEQ ID NO: 123 - protein, 243 aa, Homo sapiens
MCSRGWDSCLALELLLLPLSLLVTSIQGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLDPVPKPVIKIEKIEDMDDNCYLKLSCVIPGESVNYTWYGDKRPFPKELQNSVLETTLMPHNYSRCYTCQVSNSVSSKNGTVCLSPPCTLARSFGVEWIASWLVVTVPTILGLLLT

SEQ ID NO: 124 - protein, 288 aa, Homo sapiens
MKPSGEDQAALAAGPWEECFQAAVQLALRAGQIIRKALTEEKRVSTKTSAADLVTETDHLVEDLIISELRERFPSHRFIAEEAAASGAKCVLTHSPTWIIDPIDGTCNFVHRFPTVAVSIGFAVRQELEFGVIYHCTEERLYTGRRGRGAFCNGQRLRVSGETDLSKALVLTEIGPKRDPATLKLFLSNMERLLHAKAHGVRVIGSSTLALCHLASGAADAYYQFGLHCWDLAAATVIIREAGGIVIDTSGGPLDLMACRVVAASTREMAMLIAQALQTINYGRDDEK

SEQ ID NO: 125 - protein, 643 aa, Homo sapiens
MQAPRELAVGIDLGTTYSCVGVFQQGRVEILANDQGNRTTPSYVAFTDTERLVGDAAKSQAALNPHNTVFDAKRLIGRKFADTTVQSDMKHWPFRVVSEGGKPKVRVCYRGEDKTFYPEEISSMVLSKMKETAEAYLGQPVKHAVITVPAYFNDSQRQATKDAGAIAGLNVLRIINEPTAAAIAYGLDRRGAGERNVLIFDLGGGTFDVSVLSIDAGVFEVKATAGDTHLGGEDFDNRLVNHFMEEFRRKHGKDLSGNKRALRRLRTACERAKRTLSSSTQATLEIDSLFEGVDFYTSITRARFEELCSDLFRSTLEPVEKALRDAKLDKAQIHDVVLVGGSTRIPKVQKLLQDFFNGKELNKSINPDEAVAYGAAVQAAVLMGDKCEKVQDLLLLDVAPLSLGLETAGGVMTTLIQRNATIPTKQTQTFTTYSDNQPGVFIQVYEGERAMTKDNNLLGRFELSGIPPAPRGVPQIEVTFDIDANGILSVTATDRSTGKANKITITNDKGRLSKEEVERMVHEAEQYKAEDEAQRDRVAAKNSLEAHVFHVKGSLQEESLRDKIPEEDRRKMQDKCREVLAWLEHNQLAEKEEYEHQKRELEQICRPIFSRLYGGPGVPGGSSCGTQARQGDPSTGPIIEEVD

SEQ ID NO: 126 - protein, 814 aa, Homo sapiens
MQDAENVAVPEAAEERAEPGQQQPAAEPPPAEGLLRPAGPGAPEAAGTEASSEEVGIAEAGPESEVRTEPAAEAEAASGPSESPSPPAAEELPGSHAEPPVPAQGEAPGEQARDERSDSRAQAVSEDAGGNEGRAAEAEPRALENGDADEPSFSDPEDFVDDVSEEELLGDVLKDRPQEADGIDSVIVVDNVPQVGPDRLEKLKNVIHKIFSKFGKITNDFYPEEDGKTKGYIFLEYASPAHAVDAVKNADGYKLDKQHTFRVNLFTDFDKYMTISDEWDIPEKQPFKDLGNLRYWLEEAECRDQYSVIFESGDRTSIFWNDVKDPVSIEERARWTETYVRWSPKGTYLATFHQRGIALWGGEKFKQIQRFSHQGVQLIDFSPCERYLVTFSPLMDTQDDPQAIIIWDILTGHKKRGFHCESSAHWPIFKWSHDGKFFARMTLDTLSIYETPSMGLLDKKSLKISGIKDFSWSPGGNIIAFWVPEDKDIPARVTLMQLPTRQEIRVRNLFNVVDCKLHWQKNGDYLCVKVDRTPKGTQGVVTNFEIFRMREKQVPVDVVEMKETIIAFAWEPNGSKFAVLHGEAPRISVSFYHVKNNGKIELIKMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 127 - protein, 395 aa, Homo sapiens
MRNIMYFGGTCQSPALPALVRPPAPPLQPSLDIKPFLPFPLDTAAAVNLFPNFNAMDPIQKAVINHTFGVPLPHRRKQIISCNICQLRFNSDSQAAAHYKGTKHAKKLKALEAMKNKQKSVTAKDSAKTTFTSITTNTINTSSDKTDGTAGTPAISTTTTVEIRKSSVMTTEITSKVEKSPTTATGNSSCPSTETEEEKAKRLLYCSLCKVAVNSASQLEAHNSGTKHKTMLEARNGSGTIKAFPRAGVKGKGPVNKGNTGLQNKTFHCEICDVHVNSETQLKQHISSRRHKDRAAGKPPKPKYSPYNKLQKTAHPLGVKLVFSKEPSKPLAPRILPNPLAAAAAAAAVAVSSPFSLRTAPAATLFQTSALPPALLRPAPGPIRTAHTPVLFAPY

SEQ ID NO: 128 - protein, 254 aa, Homo sapiens
MSAGGDFGNPLRKFKLVFLGEQSVAKTSLITRFRYDSFDNTYQAIIGIDFLSKTMYLEDGTIGLRLWDTAGQERLRSLIPRYIRDSAAAVVVYDITNVNSFQQTTKWIDDVRTERGSDVIITLVGNRTDLADKRQVSVEEGERKAKGLNVTFIETRAKTGYNVKQLFRRVAAALPGMESTQDGSREDMSDIKLEKPQEQTVSEGGCSCYSPMSSSTLPQKPPYSFIDCSVNIGLNLFPSLITFCNSSLLPVSWR

SEQ ID NO: 129 - protein, 855 aa, Homo sapiens
MGRKLDPTKEKRGPGRKARKQKGAETELVRFLPAVSDENSKRLSSRARKRAAKRRLGSVEAPKTNKSPEAKPSPGKLPKGISAGAVQTAGKKGPQSLFNAPRGKKRPAPGSDEEEEEEDSEEDGMVNHGDLWGSEDDADTVDDYGADSNSEDEEEGEALLPIERAARKQKAREAAAGIQWSEEETEDEEEEKEVTPESGPPKVEEADGGLQINVDEEPFVLPPAGEMEQDAQAPDLQRVHKRIQDIVGILRDFGAQREEGRSRSEYLNRLKKDLAIYYSYGDFLLGKLMDLFPLSELVEFLEANEVPRPVTLRTNTLKTRRRDLAQALINRGVNLDPLGKWSKTGLVVYDSSVPIGATPEYLAGHYMLQGASSMLPVMALAPQEHERILDMCCAPGGKTSYMAQLMKNTGVILANDANAERLKSVVGNLHRLGVTNTIISHYDGRQFPKVVGGFDRVLLDAPCSGTGVISKDPAVKTNKDEKDILRCAHLQKELLLSAIDSVNATSKTGGYLVYCTCSITVEENEWVVDYALKKRNVRLVPTGLDFGQEGFTRFRERRFHPSLRSTRRFYPHTHNMDGFFIAKFKKFSNSIPQSQTGNSETATPTNVDLPQVIPKSENSSQPAKKAKGAAKTKQQLQKQQHPKKASFQKLNGISKGADSELSTVPSVTKTQASSSFQDSSQPAGKAEGIREPKVTGKLKQRSPKLQSSKKVAFLRQNAPPKGTDTQTPAVLSPSKTQATLKPKDHHQPLGRAKGVEKQQFAEQPFEKAAFQKQNDTPKGLSLPLCLPSVPAAPHQQRGRNLSPGATASCCYLRWLKTRRVAHCHCHQVGTLASVRMPSLLCIPMKFNTHFKTSGH

SEQ ID NO: 130 - protein, 770 aa, Homo sapiens
MSNEVETSATNGQPDQQAAPKAPSKKEKKKGPEKTDEYLLARFKGDGVKYKAKLIGIDDVPDARGDKMSQDSMMKLKGMAARGRSQGQHKQRIWVNISLSGIKIIDEKTGVIEHEHPVNKISFIARDVTDNRAFGYVCGGEGQHQFFTIKTGQQAEPLVVDLKDLFQVIYNVKKKEEEKKKIEEASKAVENGSEALRILDDQTNKLKSGVDQMDLFGDMSTPPDLNSPTESKDILLVDLNSEIDTNQNSLRENPFLTNGITSCSLPRPTPQASFLPENAFSANLNFFPTPNPDPFRDDPFTQPDQSTPSSFDSLKSPDQKKENSSSSSTPLSNGPLNGDVDYFGQQFDQISNRTGKQEAQAGPWPFSSSQTQPAVRTQNGVSEREQNGFSVKSSPNPFVGSPPKGLSIQNGVKQDLESSVQSSPHDSIAIIPPPQSTKPGRGRRTAKSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 131 - protein, 229 aa, Homo sapiens
MTPQLLLALVLWASCPPCSGRKGPPAALTLPRVQCRASRYPIAVDCSWTLPPAPNSTSPVSFIATYRLGMAARGHSWPCLQQTPTSTSCTITDVQLFSMAPYVLNVTAVHPWGSSSSFVPFITEHIIKPDPPEGVRLSPLAERQLQVQWEPPGSWPFPEIFSLKYWIRYKRQGAARFHRVGPIEATSFILRAVRPRARYYVQVAAQDLTDYGELSDWSLPATATMSLGK

SEQ ID NO: 132 - protein, 247 aa, Homo sapiens
MNPFLILAFVGAAVAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTAPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 133 - protein, 677 aa, Homo sapiens
MPGFLVRILLLLLVLLLLGPTRGLRNATQRMFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEMGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVRSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 134 - protein, 373 aa, Homo sapiens
MLKRKPSNVSEKEKHQKPKRSSSFGNFDRFRNNSLSKPDDSTEAHEGDPTNGSGEQSKTSNNGGGLGKKMRAISWTMKKKVGKKYIKALSEEKDEEDGENAHPYRNSDPVIGTHTEKVSLKASDSMDSLYSGQSSSSGITSCSDGTSNRDSFRLDDDGPYSGPFCGRARVHTDFTPSPYDTDSLKIKKGDIIDIICKTPMGMWTGMLNNKVGNFKFIYVDVISEEEAAPKKIKANRRSNSKKSKTLQEFLERIHLQEYTSTLLLNGYETLEDLKDIKESHLIELNIENPDDRRRLLSAAENFLEEEIIQEQENEPEPLSLSSDISLNKSQLDDCPRDSGCYISSGNSDNGKEDLESENLSDMVHKIIITEPSD

SEQ ID NO: 135 - protein, 292 aa, Homo sapiens
MGRQKELVSRCGEMLHIRYRLLRQALAECLGTLILVMFGCGSVAQVVLSRGTHGGFLTINLAFGFAVTLGILIAGQVSGAHLNPAVTFAMCFLAREPWIKLPIYTLAQTLGAFLGAGIVFGLYYDAIWHFADNQLFVSGPNGTAGIFATYPSGHLDMINGFFDQFIGTASLIVCVLAIVDPYNNPVPRGLEAFTVGLVVLVIGTSMGFNSGYAVNPARDFGPRLFTALAGWGSAVFTTGQHWWWVPIVSPLLGSIAGVFVYQLMIGCHLEQPPPSNEEENVKLAHVKHKEQI

SEQ ID NO: 136 - protein, 286 aa, Homo sapiens
MADLEEQLSDEEKVRIAAKFIIHAPPGEFNEVFNDVRLLLNNDNLLREGAAHAFAQYNLDQFTPVKIEGYEDQVLITEHGDLGNGKFLDPKNRICFKFDHLRKEATDPRPCEVENAVESWRTSVETALRAYVKEHYPNGVCTVYGKKIDGQQTIIACIESHQFQAKNFWNGRWRSEWKFTITPSTTQVVGILKIQVHYYEDGNVQLVSHKDIQDSLTVSNEVQTAKEFIKIVEAAENEYQTAISENYQTMSDTTFKALRRQLPVTRTKIDWNKILSYKIGKEMQNA

SEQ ID NO: 137 - protein, 372 aa, Homo sapiens
MSRLLGGTLERVCKAVLLLCLLHFLVAVILYFDVYAQHLAFFSRFSARGPAHALHPAASSSSSSSNCSRPNATASSSGLPEVPSALPGPTAPTLPPCPDSPPGLVGRLLIEFTSPMPLERVQRENPGVLMGGRYTPPDCTPAQTVAVIIPFRHREHHLRYWLHYLHPILRRQRLRYGVYVINQHGEDTFNRAKLLNVGFLEALKEDAAYDCFIFSDVDLVPMDDRNLYRCGDQPRHFAIAMDKFGFRLPYAGYFGGVSGLSKAQFLRINGFPNEYWGWGGEDDDIFNRISLTGMKISRPDIRIGRYRMIKHDRDKHNEPNPQRFTKIQNTKLTMKRDGIGSVRYQVLEVSRQPLFTNITVDIGRPPSWPPRG

SEQ ID NO: 138 - protein, 526 aa, Homo sapiens
MVAKDYPFYLTVKRANCSLELPPASGPAKDAEEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 139 - protein, 609 aa, Homo sapiens
MESTAYPLNLSLKEEEEEEEIQSRELEDGPADMQKVRICSEGGWVPALFDEVAIYFSDEEWEVLTEQQKALYREVMRMNYETVLSLEFPFPKPDMITRLEGEEESQNSDEWQLQGGTSAENEESDVKPPDWPNPMNATSQFPQPQHFDSFGLRLPRDITELPEWSEGYPFYMAMGFPGYDLSADDIAGKFQFSRGMRRSYDAGFKLMVVEYAESTNNCQAAKQFGVLEKNVRDWRKVKPQLQNAHAMRRAFRGPKNGRFALVDQRVAEYVRYMQAKGDPITREAMQLKALEIAQEMNIPEKGFKASLGWCRRMMRRYDLSLRHKVPVPQHLPEDLTEKLVTYQRSVLALRRAHDYEVAQMGNADETPICLEVPSRVTVDNQGEKPVLVKTPGREKLKITAMLGVLADGRKLPPYIILRGTYIPPGKFPSGMEIRCHRYGWMTEDLMQDWLEVVWRRRTGAVPKQRGMLILNGFRGHATDSVKNSMESMNTDMVIIPGGLTSQLQVLDVVVYKPLNDSVRAQYSNWLLAGNLALSPTGNAKKPPLGLFLEWVMVAWNSISSESIVQGFKKCHISSNLEEEDDVLWEIESELPGGGEPPKDCDTESMAESN

SEQ ID NO: 140 - protein, 419 aa, Homo sapiens
MAAEVLPSARWQYCGAPDGSQRAVLVQFSNGKLQSPGNMRFTLYENKDSTNPRKRNQRILAAETDRLSYVGNNFGTGALKCNTLCRHFVGILNKTSGQMEVYDAELFNMQPLFSDVSVESELALESQTKTYREKMDSCIEAFGTTKQKRALNTRRMNRVGNESLNRAVAKAAETIIDTKGVTALVSDAIHNDLQDDSLYLPPCYDDAAKPEDVYKFEDLLSPAEYEALQSPSEAFRNVTSEEILKMIEENSHCTFVIEALKSLPSDVESRDRQARCIWFLDTLIKFRAHRVVKRKSALGPGVPHIINTKLLKHFTCLTYNNGRLRNLISDSMKAKITAYVIILALHIHDFQIDLTVLQRDLKLSEKRMMEIAKAMRLKISKRRVSVAAGSEEDHKLGTLSLPLPPAQTSDRLAKRRKIT

SEQ ID NO: 141 - protein, 266 aa, Homo sapiens [sequence omitted]

SEQ ID NO: 142 - DNA, 2372 bp, Homo sapiens
gtggccgtccaggccccgccccgcagcccagccggaagggccggcggacgctcgctaggtcggctcgctggccggggctccgcggctcccgtggttgccatggcggcggttgtcgcggcgacgaggtggtggcagctgttgctggtgctcagcgccgcggggatgggggcctcgggcgccccgcagccccccaacatcctgctcctgctcatggacgacatgggatggggtgacctcggggtgtatggagagccctccagagagaccccgaatttggaccggatggctgcagaagggctgcttttcccaaacttctattctgccaaccctctgtgctcgccatcgagggcggcactgctcacaggacggctacccatccgcaatggcttctacaccaccaacgcccatgccagaaacgcctacacaccgcaggagattgtgggcggcatcccagactcggagcagctcctgccggagcttctgaagaaggccggctacgtcagcaagattgtcggcaagtggcatctgggtcacaggccccagttccaccccctgaagcacggatttgatgagtggtttggatcccccaactgccactttggaccttatgacaacaaggccaggcccaacatccctgtgtacagggactgggagatggttggcagatattatgaagaatttcctattaatctgaagacgggggaagccaacctcacccagatctacctgcaggaagccctggacttcattaagagacaggcacggcaccacccctttttcctctactgggctgtcgacgccacgcacgcacccgtctatgcctccaaacccttcttgggcaccagtcagcgagggcggtatggagacgccgtccgggagattgatgacagcattgggaagatactggagctcctccaagacctgcacgtcgcggacaacaccttcgtcttcttcacgtcggacaacggcgctgccctcatttccgcccccgaacaaggtggcagcaacggcccctttctgtgtgggaagcagaccacgtttgaaggagggatgagggagcctgccctcgcatggtggccagggcacgtcactgcaggccaggtgagccaccagctgggcagcatcatggacctcttcaccaccagcctggcccttgcgggcctgacgccgcccagcgacagggccattgatggcctcaacctcctccccaccctcctgcagggccggctgatggacaggcctatcttctattaccgtggcgacacgctgatggcggccaccctcgggcagcacaaggctcacttctggacctggaccaactcctgggagaacttcagacagggcattgatttctgccctgggcagaacgtttcaggggtcacaactcacaatctggaagaccacacgaagctgcccctgatcttccacctgggacgggacccaggggagaggttccccctcagctttgccagcgccgagtaccaggaggccctcagcaggatcacctcggtcgtccagcagcaccaggaggccttggtccccgcgcagccccagctcaacgtgtgcaactgggcggtcatgaactgggcacctccgggctgtgaaaagttagggaagtgtctgacacctccagaatccattcccaagaagtgcctctggtcccactagcacctgcgcagactcaggccaggcctagaatctccggttggccctgcaagtgcctggaggaaggatggctctggcctcggtcctcccccaaccctgcccaagccagacagacagcacctgcagacgcagggggactgcacaattccacctgcccaggacctgaccctggcgtgtgcttggccctcctcctcgcccacggcgcctcagatttcaggaccctcctcctcgcccacggcgcctcagacctcaggaccctgccgtctcacgcctttgtgaaccccaaatatctgagaccagtctcagtttattttgccaaggttaaggatgcacctgtgacagcctcaggaggtcctgacaacaggtgcctgaggtggctggggatacagtttgcctttatacatcttagggagacacaagatcagtatgtgtatggcgtacattggttcagtcagccttccactgaatacacgattgagtctggcccagtgaatccgcatttttatgtaaacagtaagggaacggggcaatcatataagcgtttgtctcaggggagccccagagggatgacttccagttccgtctgtcctttgtccacaaggaatttccctggacgctaattatgagggaggcgtgtagcttcttatcattgtaactatgttatttagaaataaaacgggaggcaggtttgcctaattcccagcttg

SEQ ID NO: 143 - DNA, 1548 bp, Homo sapiens
gacctttcagagccaggagggctttcgggggcgtggggcgcgctgcggagcggagccgcggctcgacggcggtgcgctggcggcgagtgtatgcagacggcgcccggcccgaaccccgagccccgcggggctccccacccgccggcctcccgcccctcccgcgcctccgcctggggaccacgtcggccttttgttggcgaaccgtcctttctttcagcgctttgcgcagcaacggaaatttcattgctcctgggtggaaattaaagggactcgcgttccctctctccctctccctctcccactctccctctctttctctctctcgcccacccttcccccttcttcccccacctttcccgcgaagccggagtcagcatctccaggcgcgggatcccgctccgagcacctcgcagctgtccggctgccgccccttccatgggcgccgcgctcgcctgcagccgccgccgccgcggggcgggcgcgatgccacgatgggcctaatctggctgctactgctcagcctgctggagcccggctggcccgcagcgggccctggggcgcggttgcggcgcgatgcgggcggccgtggcggcgtctacgagcaccttggcggggcgccccggcgccgcaagctctactgcgccacgaagtaccacctccagctgcacccgagcggccgcgtcaacggcagcctggagaacagcgcctacagtattttggagataacggcagtggaggtgggcattgtggccatcaggggtctcttctccgggcggtacctggccatgaacaagaggggacgactctatgcttcggagcactacagcgccgagtgcgagtttgtggagcggatccacgagctgggctataatacgtatgcctcccggctgtaccggacggtgtctagtacgcctggggcccgccggcagcccagcgccgagagactgtggtacgtgtctgtgaacggcaagggccggccccgcaggggcttcaagacccgccgcacacagaagtcctccctgttcctgccccgcgtgctggaccacagggaccacgagatggtgcggcagctacagagtgggctgcccagaccccctggtaagggggtccagccccgacggcggcggcagaagcagagcccggataacctggagccctctcacgttcaggcttcgagactgggctcccagctggaggccagtgcgcactagctgggcctggtggccaccgccagagctcctggcgacatcttggcgtggcagcctcttgactctgactctcctccttgagcccttgcccctgcgtcccgcgtctgggttctcagctatttccagagccagctcaaatcagggtccagtgggaactgaagagggcccaagtcggagctcggagggggctgcctgcaatgcagggcatttgtgggtctgtgtggcaggaagccggcagggaagggcctgagtgccagccctggcagactgaggagcctcccaggagcagcggggcagtgtggggctttgtgtcatcacaacattaaagtattttattcta

SEQ ID NO: 144 - DNA, 2438 bp, Homo sapiens
gcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccccagggtccccgacatcctgagctcagtgaggaggggctcgggagccccagaagccgaggggcccctgccctgcccatctccggctccctttagccccctgccagccccatcccccaggatctctgacatcctgaactctgtgagaaggggttcaggaaccccagaagccgagggccccctctcagcggggcccccgccctgcctgtctccggctctcctaggccccctgtcctccccgtcccccaggatctctgacatcctgaactctgtgaggaggggctcagggaccccagaagccgagggcccctcgccagtggggcccccgccctgcccatctccgactatccctggccccctgcccaccccatcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaa

SEQ ID NO: 145 - DNA, 842 bp, Homo sapiens
cccgcccggcacccggggtgcgccctcctcggtcccgcgccctccgggctcgcagggacgtctcctccctcccggctcgcggccccgcccggcccggcccccgcccagagccccagcgcgccgaggatgtgagtcctgctcgcctctggcggagcagcagccactcgcgcgcggagccggagcgcagcgcagcgcagccgcgggcgctctccgggccgctcgcgcgagtgccgcgctcttgccctagcggcgtcccccggcctctcgccggcgccaccgccgcagcagcccgcgggccgtccccggccggccgcccccggccccagcgccgctgaccctgtccgccgcgggcggggacgcgggcggaggaggcgccgcggcggagcccccggacgcgaccatgtcggaggtgctgccctacggcgacgagaagctgagcccctacggcgacggcggcgacgtgggccagatcttctcctgccgcctgcaggacaccaacaacttcttcggcgccgggcagaacaagcggccgcccaagctgggccagatcggccggagcaagcgggttgttattgaagatgataggattgatgacgtgctgaaaaatatgaccgacaaggcacctcctggtgtctaactcccccaaagacaatgagttaagggagagaataagaacggcggtaacagttattggcaaaaagcatgaaaagagaaagcactttgaaatttattactagcttgctacccacgatgaaatcaacaacctgtatctggtatcaggccgggagacagatgaggcgagaggaggaggaggaggaggagaaggctctgggctcctctgc

SEQ ID NO: 146 - DNA, 1366 bp, Homo sapiens
gtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaaaggtcctttgttctccaatgttgctgtcaacattcagtcatttctccttatttcacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgt

SEQ ID NO: 147 - DNA, 2574 bp, Homo sapiens
aggacggcgggaagaggagtgcggaacccgcgggaggatgtgcacagagggcccaggaggagcctcaggagccggactgccgttggccaaccgagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccatatggaagcccaactggggttgcgtctgaggcctgccccctgggctggggcctcagaccccctcagccttgggaccgtgcccacgagggtcttccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgc

SEQ ID NO: 148 - DNA, 1221 bp, Homo sapiens
cgcaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccctttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttccc

SEQ ID NO: 149 - DNA, 1235 bp, Homo sapiens
gcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcagaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgag

SEQ ID NO: 150 - DNA, 2561 bp, Homo sapiens
cgccaggaacagcttgaggtacctgagccctgccctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcaccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 151 - DNA, 2475 bp, Homo sapiens
cccaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgcctccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggttgacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgttttgtactcacggcggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcat

SEQ ID NO: 152 - DNA, 4999 bp, Homo sapiens
gaggaggattcgcagttcaacatcaaggtccctgtgcgttttattgcgacctgccggtgggaactttgtctccgagtcggagcagcatggagcggcggagcgagagcccgtgtctgcgggacagccccgaccggcggagcggcagcccggacgtcaaggggcctcccccagtgaaggtggcccggctggagcagaacggcagccccatgggagcccgcgggaggcccaacggcgccgtggccaaggccgtgggaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaaggaataatcaagctgggaaggtggaaccctctccccctcagttatgtgacagatgcacccgacgcgacagtggccgacatgctacaagatgtctatcatgttgtgacgttgaaaatccaattacaaagttgttcaaagttggaagacttgcctgcggagcagtggaaccatgccacagtccgcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgggaaaacctctgtaccatccgtcgcttcctgaaccttccccagcatgagagggatgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaagacactaaagcgttacactttatcccgtctctatgactggatcatagtcattataatcacaggagactctgccttcattatccttgcacttaacggaagttacatcaggcaagttccaggatgaaaagaactatgaaataaatgaaggaagctacaagtgtgtgtgtatatgtatatgtatatatctctatatttacatatatatattaaaattgcatgggacagagactttgcaatccgaaagaatagactgtgaaatgagttcttaaagaaaagacttgtttatgtattaaaaaaaccacttcacagtgagtcgctttggctttttgataaactgcggcctgctctcagggtggggtgactatttttgaattcctatttattttttgtgtttgtccctgatttttttttttaattctatggcttcctatctggcagcttaatgggtaatttttgaggtatgtatttaacaaaataaacgacactgccgaaaaaaaaaaaagtgaagtgaaaacaatcagggcacattaaaatgatacaagtcaaataaatcttaaagacacaatgcacacttaaaatgactcaataaaatgacttgctacgttccgttattcaatttgtcattactgtagtgaacagatgcatttctgtggaattccaaataagtaaaactgaaattcagtgcagagaaaactttgtccactagtgcaagtcttgatcaaatgacattttgacattggacatatggaattcatagtatgagccacattttgttgtgaaatttatttacctgcttgtggcttcaaatctgaaaattaataagcctgctcgtttaaaagttgtttgttgttgctgtttttttgtctttttgttttttactagaaaatagttcagtgtaatattaagttagaaaagaagttgctgcccagttaaaggggctccctctcaaataaatctccatccttccctctcccaaaagacatttctgatttctgcttcactttgggcttcctcttcttcgtacacattccatctacctaatcaaacattttcagtccctgatctctcctgtcccttttcctgggatgacagccctaacaagaactgtttttgaatcgttgtgcagctccaggcaatagagtatgtgaagcgatttcagtagaatcacttactcatcctaaaagaaaacattatcccagttacctacatcgcaattaccttatgtaaagcagaactaatgctgactggatgtttaatgggatgagcattaaagctgcaatctactatagtactccagatctctttcggcttcctatgagaaacaccagaagcattactttccacttctacttacagtaattgcaagaggagacctcacattcaggactggcctagtgaacgtaatccatgctttaaactggccattaaacagtcccacatggttggattttttttttttttttgagttgtgctttcacaaaaccttgtcaaagacctcatgcaatatcactttgaaagttattttctgtttactacacaaacattgtaatataactgttaatactatttatatatttgaaaggtataaaaggtaggagttaaaaaaaaaacctctatgtgtagatattaactcagaacttacaatatacagggagaagacatgttgcaatacaagctaattctagctgctcagtaacctctggagtttttaaagggacattttcctgtactttttcaaataatgatgtttaaaaattatcttgacataagcgtcatatacctttgcaaaaggatggttgtttgcagttagccctggccccatccttcctatttctgtagtatgctgcagctttaatcagaaagtccatggttgctgcttcctgatctccgagttactctttccaaattgtcttcttacactgttgctgaaggtcactctgtacacgtaatggaaactgattttgccaagctcttacaaggtggttcatctatcgatggcatccgcatttggtatcttttacacttcaaccaaaaatttattaggtatttttcaatgctaagtcttgccttttattttttaatttcactgccaagtttgcagtggttctaagtgaatctgtgggcattttagcctgtggtcttgccagatctttgcgaattacaatgcatatatgtctatttattcaatatctgtcatataatatctatttggaagaagaaactttctcttgtagtgcctcttgacaaagcacaatttcccgcctttttttttttttttgtgaaatgaaaaaaacaaattgtgttttattgcggtatcaacaatgtgaataaggattaacatattgtaaatgttcttttttccatgtaaatcaactatctttgttatcactaagtgataattaatttttaacttatgtgcattgttaggctgttagaattttttggttgttaaaataaacgcattcaataaatatg

SEQ ID NO: 153 - DNA, 1330 bp, Homo sapiens
gaaaggggctgatcaggactggtgagagggccccccaggagagggcagaggtggttgtccccaccccttctgcagcagttgccccaggcacctgttcgacattggtgtctgagacagtgttgctactgctgagggaacatcaccctggctcacctccatctttcaaaatatggcaagctgcacaaatcgcggaggcctcccagagaaacacagctcctccaaggtgtcaagccacgcccaaatgatccaaaaagcagttgattttttagaccttttaatcggccacctgagcaaattctcaccagttatgatagttttccagtttagtcccttgggttttctagttagacagtcatctgcagataatgttcaatttttgtcctttgccccctccctcattctaccaagtggcacaggaaattggttggtttggtgatgctgtttagctttaatagaaacccccagcccctggaggggctggattcctttgggagcagtgttccattccattaagcttccttgcagggtggggcccactccatgaagacagcagtcatgccttaagaagcagagctaccttacgtgcctgcccaggctgttcctgcctaaatctccagccctgcatgccgtctcaagggtgggtcccagagagtttggagtgtaggattccctctgtgaaggaatcatctctacttctctgaggacaattagggtatccttggctgctttactgtggtggccgaagagctggaattgcctttgttgagagttgtgttcactatcagtggtcgtgtaccttctccacctgcccccaggaaaaagagtctcccccttaaatttcctggtaccccctcacctatgcctgaaagcatttcaccctctcaatgcctcacctttcccgttcgccagatggaaccatcagtattcctctcctggtaccgcaaggcctcctggatccaaagcaccatgtcagtattatttgttggtcctttttgtgcctttcttgacctggagggggaggcaggaggattgctgtcagcctagtttctttctgggaatatggctccctagtgttggaaagggcagtgcctcgtggacagatggtcatttagcctctggggtgaaatacttgcaataccaggtcactctgtggtccaaaaggtcacattcagttgtcatcaggcaactttaacccttagagtgcttcccttccattaagctgaaattgccccacggccatatccacccattgactctgccttcatcaaggaaggtgggaagtaaaacatcactttttacattaaaccaggatcaggaataaaatgttacc

SEQ ID NO: 154 - DNA, 4694 bp, Homo sapiens
gaagaactggaactggtctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaattaactctgctgtttgctgcatgctgcatgagacccagggtcctgtttgggcttcctgtagacacccttttcctgcgcaacagagctgggcctccctttctctaatttcccccttaacatgcctggggggcatacaatccaacccgcgccctctcctctcttcctgccaaggtttatagaaacctgagaatctgagggtgatgtctggccgctggtcaagaagccaacagtcatgtggctcgcagatgcatcctgcatcccagtccccctcccagcacccccagccatcccccctgtcttcccccacatctttgccagaggtgtgacatggtcagggggcccatctgctactctttcccaccagctcccctgttccagttctggttgctgttagtttccctgaggtatttgcaaccaccatggctgggtaaccaccgatcagcacagctgtccccttggtctcctgtatcccagtcactagtcctccctggtccaccccaccctcatcctcaggagccacagccatttcttagagggtttcaaaaggacagcctttggcgccttttccttctaacctttgagtccagccctttccagttttcattcactcgaagtaactgcactcaagctgtgctcaaaatcggcaacgcatttatttacaccaagcccttcccataaaacacaactgctgaagaaaatagcagacgtttcccctctctctaactctgggtatcccacagatgcaaaagggagaataaacctgaatattattaccagcctagagtcttgaatgatagccttaccgaattcttcttgtgaggtatttcagcatctcggggggtaatttccggaagggctccatactgtcccaataaggtgaggccagtagcaggaataataaatcccactttgtaggctggaaaactgagctgtcaaaagaatcaagtgtttgggggtttgctctgatgagtcttctagttcatttggtgaatgtcatgatgatttttaacatgcattttgcatgcatcccccaataagaagagatgagactcggctggagagaagaaaaggcccttaactttctttccaatttaaggagttgagagtttaaaaatattccagccctaagtttttatcatgggtcccatctgatagtggctttgggaacctctgtgaagtagagagccctcccttgtcagggttatgaggcacagtggcctttggtgtttggccagtgacagtgtgagagatggagttgacctggcaatgatctgtggctaacatgccgtctctctgcccttcctttgcagtaatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatataggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcccggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccagagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagcttt

SEQ ID NO: 155 - DNA, 2454 bp, Homo sapiens
ttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaaca

SEQ ID NO: 156 - DNA, 984 bp, Homo sapiens
accagatcccagaggctgaacacctcgaccttctctgcacagcagatgatccctgagcagctgaagaccagaaaagccactaagactttctgcttaattcaggagcttagaggattcttcaaagagtgtgtccacgatcctttgaagcatgagttcttaccagcagaagcagacctttaccccaccacctcagcttcaacagcagcaggtgaaacaacccagccagcctccacctcaggaaatatttgttcccacaaccaaggagccatgccactcaaaggttccacaacctggaaacacaaagattccagagccaggctgtaccaaggtccctgagccaggctgtaccaaggtccctgagccaggctgtaccaaggtccctgagccaggttgtaccaaggtccctgagccaggctgtaccaaggtccctgagccaggttgtaccaaggtccctgagccaggctacaccaaggtccctgaaccaggcagcatcaaggtccctgaccaaggcttcatcaagtttcctgagccaggtgccatcaaagttcctgagcaaggatacaccaaagttcctgtgccaggctacacaaagctaccagagccatgtccttcaacggtcactccaggcccagctcagcagaagaccaagcagaagtaatttggtgcacagacaagcccttgagaagccaaccaccagatgctggacaccctcttcccatctgtttctgtgtcttaattgtctgtagaccttgtaatcagcacattgtcaccccaagccatagtctctctcttatttgtatcctaaaaatacgtactataaagcttttgttcacacacactctgaagaatcctgtaagcccctgaattaagcagaaagtcttcatggcttttctggtcttcggctgctcagggttcatctgaagattcgaatgaaaagaaatgcatgtttcctgctcttccctcattaaattgcttttaattcca

SEQ ID NO: 157 - DNA, 4461 bp, Homo sapiens
agctcagtgtgtggtgagcggcggcggcgcggccgggccggggagcgggcgcggcccggcggcctcagcatggaggacggcttctccagctacagcagcctgtacgacacgtcctcgctgctccagttctgcaacgatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagcaagaccactgatgcagaccctgcctttaagaaccacggtcaacaatggcactgtgttaccaaagaaacctactggctctctaccatccccctccggggtcaggaaagaaactgctgtgccagcaaccaaaagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaagcaaacccaaggagcctgtattcagtgcagaagaaggctatgtaaaaatgtttcttcgtggacgccctgttaccatgtacatgcccaaagatcaagtggattcttacagcttggaagcaaaagtagaacttccaaccaagagactcaagctggaatgggtctatgggtacaggggtcgagactgccgtaacaacctgtacttgcttccgacgggagagaccgtctacttcatcgcatccgtggtggtgttatacaacgtggaggagcaactgcagaggcattacgctggccacaacgatgacgtgaagtgcctagcagttcatcctgatcggatcacgatagcaacaggacaagttgcgggcacatcgaaggatggaaaacaattgcccccacatgtgcgcatctgggattctgtgacattgaatactctccacgtcattggaataggtttttttgaccgagcagtcacctgtattgcattctcaaaatctaatggaggaaccaatctctgtgctgtggatgactccaacgaccatgtgctctctgtatgggactggcagaaagaagaaaaactagcagatgtgaagtgctctaatgaagctgtgtttgctgcggatttccaccccacggacaccaacatcatagttacttgtggaaaatcacatctctacttttggacactagaaggaagctcccttaataagaagcaaggattattcgagaaacaagaaaagccaaagtttgtcctctgtgtgactttctctgaaaacggtgacaccattactggagattcaagtggcaacatcttagtatggggaaaaggtacaaatcgaataagctatgcagttcagggggcccatgagggtggcatttttgcactttgtatgttaagagatggcacactggtgtcgggaggtgggaaagaccgaaagctcatttcttggagcggaaactatcaaaaacttcgtaaaacggagattccagaacagtttggtccaatacggacagtggccgaggggaaaggcgatgtgatcttgattggcacaactcgaaactttgtcctgcagggcactctgtcaggggacttcacacccattactcagggtcacactgatgagctctggggactggccatccatgcctcaaaatctcagttcttgacctgtgggcatgacaagcatgccactctctgggacgctgtgggtcaccgtcccgtctgggacaaaataatagaggatccagctcagtcttctggttttcatccttcagggtctgtggttgcagtcggaacactcactgggaggtggtttgtgtttgacacagaaacaaaagacttggtcaccgttcacacagatggaaacgaacagctctctgtaatgcgatactcaccagatgggaatttcttagccataggctcacatgacaactgcatctatatatatggcgttagtgacaacgggaggaagtacacgcgagtgggcaagtgctcgggtcattccagcttcattactcacctggactggtctgtaaactcacagttcctcgtgtcaaattccggagactacgaaatcctctactgggttccctctgcctgtaagcaagtcgtaagtgtggaaactacaagagacattgaatgggctacctatacctgcactttgggattccatgtttttggagtgtggccagaaggctcggacggaaccgacatcaatgccgtctgtcgggcccatgagaagaaactcctgtcaacaggcgacgactttggcaaagtgcacctcttctcatacccctgctcgcagttcagggctccaagccacatctacggcgggcacagcagccatgtcaccaatgtcgatttcctctgtgaagacagccacctcatctccacgggcgggaaagacacaagcatcatgcagtggcgcgtcatttagtacccaccgagagctgtggggagcagcatgggcaaggaagacacagactcgcattacccttggtcactgtgatttctgttttgtttaaaaaattcttacaaacctcaggaaaactgtgccctccgccggctaccttagcttagcgtgtcagcgggcgccacagcggatcagcggttccgtgttcacttttgttgtacaatatatgacacagtgcacattgaataccaacaaggttgcaacgtttacattatagccacatcaacagaagtaactggtatattcttagtaacttttctatgaactcttcaaaaatggtcacagaatgccttttaaaacattgtatataatcttcactgtttcaccatctagcttgctaagtcaaatatttatgatgataatgaggtactgaaccacgatggctgttgaggaattggtcctaaaaggacagatcacttcagaagagtgaataactgatttgcacagctgaatcaggagacacaaagatgagactgtgtttggttacattttccaaagtttcattgcattctcccttggggaggctgtgagagagggcttgtatccctcttgtgctaagcagactctactcctaactgacttcaatatttcagcagggtacacaggcgtttccaagtttcagtgacaccgtcctgcctaaccagatgcggtcagcctcttcacacccacctggcttgcatcccccatcccttgttcacacgccctgattcacggtgagacattttgccaccttcttgtgtatattacttggcatgagatgatattgtacttgtataggattctagcaattcataataaatatgtaagactaggctttactgtcttatgcttatggacattgtatatttgtattttatgaccaagtagaccaagtcagaaagatctctctcgagcgtaccataaacctgcagagagaagtctcgaaaggctccaccaggtaccaagggcagctgcttttcctgtcttttgtgcatgggcgacccattacagtatgagataagattgagttctgatgcgttaaacggaggtggcagaaatttgtcaagaaggccttatccatttcgattgtgtgacagattgaaatttattgtttacattggggaatgtatctcaaatttttaaatagaagagtaataaacagactttaaagcaaatattaagatttttactcattcaaggcaagtaaatgaatggaattatctgagctctatggcactggttgtttagagtgactgatgaagtgcaactttcaaaaacatttttgatgacatcaccagcctactgcagaagtgcagggcaccagtaaacaccatgtattattgaagatgaatctgtttgtatgtatccttgtcaaatatattctataatgaaataaaatctgaaaagtggatttcttattgacctatattcatgaaagcatataaattaaaatatttaaaattagatatgattcacactatattctgtttcatatgcagattttattctcacctgggccatttgcagatgagactgtagtttgcagatgagactgtagtttgcagatggcgtggaagcattcatcaggggagataaccataaaggatttggcctaattaccatactcaattgtcagtttacgtggttttgtgaatactggcaaaagcaattgtttttaaattaacaatggagagaatgataagatgagggaaggaaaaggcattcattattgacttacatgtcagtaaggtctgcttttatttctatgtactcctgtttgccaagctcaataatggacaaaggatacaaacacacacacatctactattttagataaatgtactgttatatatatatgtaaactactattgctctctttataatgattaatcactttattatgaatgaatgaatgaatttgatggattt

SEQ ID NO: 158 - DNA, 2183 bp, Homo sapiens
ccagggcctgactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagcgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaacttaagcatagtaatataaataaagtaatagttggatgcttttggtcctgtgttgcttttaaaaacaccttataaaagaggagagtatttgataagcaattttcatagtagtaaagttttttttcatctcttaaactaaattgaccatgcatataatattctttgtttaaatgaaagcatactgttgaaacccgcagtgttgcatttagaaaacagttgaacagaatgtcaatgtgcattcatgcaaaaaaacatttaatctgcatctgttttagaaaagggggaaatgaagcaacttgtctaaaaatactgctttacaaagcatttcagcctttccccctcagttttgcattgattttttgacaagtctgtagagcctaatagtttccatcaaaggcctagatctcttatttagcatttttttcagctcttctctcagaagttcagctgttgaaacgaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcaatttctaggtcctttgtctagaaaggaaatttgcctcagttgaattagtgaaatatttctgtcgttgatattaaaagtgacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagtatattttgtcttgcaaa

SEQ ID NO: 159 - DNA, 2765 bp, Homo sapiens
cgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcatttt

SEQ ID NO: 160 - DNA, 3427 bp, Homo sapiens
gccggcgggggcgcagcggcccgggaggtgcgtggttgagcgaagccgcggggcccaaccgcagtcgcggggtctgggaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggatcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgttctattactcaacaggaatcttcaaggatgcaggtgttcaacagcccatctatgccaccatcagcgcgggtgtggttaatactatcttcactttactttctctatttctggtggaaagggcaggaagaaggactctgcatatgataggccttggagggatggctttttgttccacgctcatgactgtttctttgttattaaagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgcttactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactagaggatataggagaggaaaagtaaggtgcagttgccccaacctcagacttaccaggaagcagatacatatgagtgtggaagccggagggtgtttatgtaagagcaccttcctcacttccatacagctctacgcggcaaattaacttgagttttatttatcttatcctctggtttaattacataaatatttattttttaagtgtaattttgccaaataataaaaacagaaggaaattgagattagagggaggtgtttaaagagaggttatagagtaaaagatttgatgctggagaggttaaggtgcaataagaattcagggagaaatgttgttcattattggagggtaaatgatgtggtgcctgaggtctgtacattacctcttaacaatttctgtccttcagatggaaactctttgatttctcagaaaagttgtatgcctatttaataaagctactcatttcctttggaactttatctttaagataatagtttacatgtagtagtacttgaaatctaggattattaactaatatgggcattgtagttaatggcggttgatgggttctaattttggatggagtccagggaagagaaagtgatttctagaaagcctgttcccctcactggacgaaataactccttgtagtagtctcattacttttgaagtaatcccgccacctatctagtgggagagccatccaaatgagaaacctaaaataattggttcttggtagagattcattatttctccactttgttctttaggagattttaggtgttgattttctgttttattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgcagcccacacttgagaggatgaatgtatgtgcactgtcactttgctctgggtggaagtatgttattgttgacttattttctctgtgtttgttcctacagcccctttttcatatgttgctcagtctccctttcccttcttggtgcttacacatctcagaccctttagccaaacccttgccagtgacagtattttggttctcagttctcactgttccctctgctcctggagcctttgaataaaaatgcacgtagctatggagtggggtttagctggaaaggtggccttccaacttcacgtcaacttctggctcctcagtttggcagtaaggcagggaagttgttttcctatttctcactgagaagattgtgaatatttccatatggattttccattattgtttgtttgattctttgttttaaaataaaaattctgaatgt

SEQ ID NO: 161 - DNA, 4950 bp, Homo sapiens
cagagcagggtggagagggcggtgggaggcgtgtgcctgagtgggctctactgccttgttccatattattttgtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcagctaaagaacagtatttcattccaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcacgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccatgtgggactaatgaatgcttcatagtggaaatatttgaaatatattgtaaaatacagaacagacttatttttattatgagaataaagactttttttctgcatttg

SEQ ID NO: 162 - DNA, 69 bp, Homo sapiens
gctgtgaaaagttagggaagtgtctgacacctccagaatccattcccaagaagtgcctctggtcccact

SEQ ID NO: 163 - DNA, 69 bp, Homo sapiens
gctatttccagagccagctcaaatcagggtccagtgggaactgaagagggcccaagtcggagctcggag

SEQ ID NO: 164 - DNA, 70 bp, Homo sapiens
agcaggagatcattaagaccacggagcagctcatcgaggccgtcaacaacggtgactttgaggcctacgc

SEQ ID NO: 165 - DNA, 60 bp, Homo sapiens
gaagatgataggattgatgacgtgctgaaaaatatgaccgacaaggcacctcctggtgtc

SEQ ID NO: 166 - DNA, 69 bp, Homo sapiens
gagccgctagtgaaaatctggcatgaaataaggactaatggccccaaaaaaggaggtggctctaagtaa

SEQ ID NO: 167 - DNA, 69 bp, Homo sapiens
cccacaaaacttcagtgtggtacaaggtggagaaagcatatcccaccaacctccagtgtcagggtccag

SEQ ID NO: 168 - DNA, 69 bp, Homo sapiens
caaatgcccaggccgcagctctgtataaggtctctgatgccactggacagatgaacctgaccaaggtgg

SEQ ID NO: 169 - DNA, 70 bp, Homo sapiens
gaactcaagctgtagccaaacagtagagatggagggccgggaagcaaaccgtgccctggtattgtcagac

SEQ ID NO: 170 - DNA, 69 bp, Homo sapiens
ctagagtcctactgtaggattgagcctgagataccggagtcctctcgccaggaacagcttgaggtacct

SEQ ID NO: 171 - DNA, 69 bp, Homo sapiens
cctttagtgagcttagcacagcgggattaaacagtcctttaaccagcacagccagttaaaagatgcagc

SEQ ID NO: 172 - DNA, 69 bp, Homo sapiens
gcagttaagccagagccaaccaactcttccgtggaagtctctccagatatctaccagcaagtcagagat

SEQ ID NO: 173 - DNA, 69 bp, Homo sapiens
gtgcctcgtggacagatggtcatttagcctctggggtgaaatacttgcaataccaggtcactctgtggt

SEQ ID NO: 174 - DNA, 70 bp, Homo sapiens
ctaagtttttatcatgggtcccatctgatagtggctttgggaacctctgtgaagtagagagccctccctt

SEQ ID NO: 175 - DNA, 69 bp, Homo sapiens
gctgggattgggctaaggactgtggtcttatctgtccacatacagccaaaatgcctatccagaaatcca

SEQ ID NO: 176 - DNA, 70 bp, Homo sapiens
aggtgccatcaaagttcctgagcaaggatacaccaaagttcctgtgccaggctacacaaagctaccagag

SEQ ID NO: 177 - DNA, 69 bp, Homo sapiens
gataagattgagttctgatgcgttaaacggaggtggcagaaatttgtcaagaaggccttatccatttcg

SEQ ID NO: 178 - DNA, 70 bp, Homo sapiens
cgtgatcctggaacgtgctctagttcgagagagtgagggctttgaggagcatgtaccatctgataactct

SEQ ID NO: 179 - DNA, 70 bp, Homo sapiens
acaaaagcatccatcccctcatagttaagtagccactggtgtcctgggaatttctggttggatttggtgc

SEQ ID NO: 180 - DNA, 70 bp, Homo sapiens
aaaaatgcacgtagctatggagtggggtttagctggaaaggtggccttccaacttcacgtcaacttctgg

SEQ ID NO: 181 - DNA, 69 bp, Homo sapiens
tacagctgtaagtgcttggagggccatggaggtgtcctctgtgatgaagaggaggatctgtttaaccca

SEQ ID NO: 182 - protein, 522 aa, Homo sapiens
MAAVVAATRWWQLLLVLSAAGMGASGAPQPPNILLLLMDDMGWGDLGVYGEPSRETPNLDRMAAEGLLFPNFYSANPLCSPSRAALLTGRLPIRNGFYTTNAHARNAYTPQEIVGGIPDSEQLLPELLKKAGYVSKIVGKWHLGHRPQFHPLKHGFDEWFGSPNCHFGPYDNKARPNIPVYRDWEMVGRYYEEFPINLKTGEANLTQIYLQEALDFIKRQARHHPFFLYWAVDATHAPVYASKPFLGTSQRGRYGDAVREIDDSIGKILELLQDLHVADNTFVFFTSDNGAALISAPEQGGSNGPFLCGKQTTFEGGMREPALAWWPGHVTAGQVSHQLGSIMDLFTTSLALAGLTPPSDRAIDGLNLLPTLLQGRLMDRPIFYYRGDTLMAATLGQHKAHFWTWTNSWENFRQGIDFCPGQNVSGVTTHNLEDHTKLPLIFHLGRDPGERFPLSFASAEYQEALSRITSVVQQHQEALVPAQPQLNVCNWAVMNWAPPGCEKLGKCLTPPESIPKKCLWSH

SEQ ID NO: 183 - protein, 239 aa, Homo sapiens
MGLIWLLLLSLLEPGWPAAGPGARLRRDAGGRGGVYEHLGGAPRRRKLYCATKYHLQLHPSGRVNGSLENSAYSILEITAVEVGIVAIRGLFSGRYLAMNKRGRLYASEHYSAECEFVERIHELGYNTYASRLYRTVSSTPGARRQPSAERLWYVSVNGKGRPRRGFKTRRTQKSSLFLPRVLDHRDHEMVRQLQSGLPRPPGKGVQPRRRRQKQSPDNLEPSHVQASRLGSQLEASAH

SEQ ID NO: 184 - protein, 666 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSAAATSPKGTLPPAALEPQTTVIHNPVDGIKESSDSANTTIEDEDAKAPRVPDILSSVRRGSGAPEAEGPLPCPSPAPFSPLPAPSPRISDILNSVRRGSGTPEAEGPLSAGPPPCLSPALLGPLSSPSPRISDILNSVRRGSGTPEAEGPSPVGPPPCPSPTIPGPLPTPSRKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 185 - protein, 78 aa, Homo sapiens
MSEVLPYGDEKLSPYGDGGDVGQIFSCRLQDTNNFFGAGQNKRPPKLGQIGRSKRVVIEDDRIDDVLKNMTDKAPPGV

SEQ ID NO: 186 - protein, 379 aa, Homo sapiens
MAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGIIAANVLVFCLWRVPSLQRTMIRYFTSNPASKVLCSPMLLSTFSHFSLFHMAANMYVLWSFSSSIVNILGQEQFMAVYLSAGVISNFVSYVGKVATGRYGPSLGASGAIMTVLAAVCTKIPEGRLAIIFLPMFTFTAGNALKAIIAMDTAGMILGWKFFDHAAHLGGALFGIWYVTYGHELIWKNREPLVKIWHEIRTNGPKKGGGSK

SEQ ID NO: 187 - protein, 346 aa, Homo sapiens
MDLDLLDLNPRIIAAIKKAKLKSVKEVLHFSGPDLKRLTNLSSPEVWHLLRTASLHLRGSSILTALQLHQQKERFPTQHQRLSLGCPVLDALLRGGLPLDGITELAGRSSAGKTQLALQLCLAVQFPRQHGGLEAGAVYICTEDAFPHKRLQQLMAQQPRLRTDVPGELLQKLRFGSQIFIEHVADVDTLLECVNKKVPVLLSRGMARLVVIDSVAAPFRCEFDSQASAPRARHLQSLGATLRELSSAFQSPVLCINQVTEAMEEQGAAHGPLGFWDERVSPALGITWANQLLVRLLADRLREEEAALGCPARTLRVLSAPHLPPSSCSYTISAEGVRGTPGTQSH

SEQ ID NO: 188 - protein, 348 aa, Homo sapiens
MYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILERNKARDLALAIRDSERQGKAQVEIVTDGEEPAEMIQVLGPKPALKEGNPEEDLTADKANAQAAALYKVSDATGQMNLTKVADSSPFALELLISDDCFVLDNGLCGKIYIWKGRKANEKERQAALQVAEGFISRMQYAPNTQVEILPQGRESPIFKQFFKDWK

SEQ ID NO: 189 - protein, 328 aa, Homo sapiens
MRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRGDVVNQDDLYQALASGKIAAAGLDVTSPEPLPTNHPLLTLKNCVILPHIGSATHRTRNTMSLLAANNLLAGLRGEPMPSELKL

SEQ ID NO: 190 - protein, 778 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGEGVKSCHLGRQPSLAKRVLVRGSQGGTTQRVQGVRASAYLAPRTPTHRLDPARASCFSRLEGPGPRGRTLCPQRLQALISPSGPSFHPSTHPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGLSNLAPRTLALRERLKSCLTAIHCFHEARLDDECAFYTSRAPPSGPTRVCTNPVATLLEWQDALCFIPVGSAAPQGSP

SEQ ID NO: 191 - protein, 389 aa, Homo sapiens
MLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 192 - protein, 733 aa, Homo sapiens
MERRSESPCLRDSPDRRSGSPDVKGPPPVKVARLEQNGSPMGARGRPNGAVAKAVGGLMIPVFCVVEQLDGSLEYDNREEHAEFVLVRKDVLFSQLVETALLALGYSHSSAAQAQGIIKLGRWNPLPLSYVTDAPDATVADMLQDVYHVVTLKIQLQSCSKLEDLPAEQWNHATVRNALKELLKEMNQSTLAKECPLSQSMISSIVNSTYYANVSATKCQEFGRWYKKYKKIKVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQGLLSEILRKEEDPRTASQSLLVNLRAMQNFLNLPEVERDRIYQDERERSMNPNVSMVSSASSSPSSSRTPQAKTSTPTTDLPIKVDGANINITAAIYDEIQQEMKRAKVSQALFAKVAANKSQGWLCELLRWKENPSPENRTLWENLCTIRRFLNLPQHERDVIYEEESRHHHSERMQHVVQLPPEPVQVLHRQQSQPAKESSPPREEAPPPPPPTEDSCAKKPRSRTKISLEALGILQSFIHDVGLYPDQEAIHTLSAQLDLPKHTIIKFFQNQRYHVKHHGKLKEHLGSAVDVAEYKDEELLTESEENDSEEGSEEMYKVEAEEENADKSKAAPAEIDQR

SEQ ID NO: 193 - protein, 88 aa, Homo sapiens
MASCTNRGGLPEKHSSSKVSSHAQMIQKAVDFLDLLIGHLSKFSPVMIVFQFSPLGFLVRQSSADNVQFLSFAPSLILPSGTGNWLVW

SEQ ID NO: 194 - protein, 427 aa, Homo sapiens
MAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKN

SEQ ID NO: 195 - protein, 277 aa, Homo sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVADGCDFVCRSKPRNVPAAYRGVGDDQLGEESEERDDHLLPM

SEQ ID NO: 196 - protein, 169 aa, Homo sapiens
MSSYQQKQTFTPPPQLQQQQVKQPSQPPPQEIFVPTTKEPCHSKVPQPGNTKIPEPGCTKVPEPGCTKVPEPGCTKVPEPGCTKVPEPGCTKVPEPGCTKVPEPGYTKVPEPGSIKVPDQGFIKFPEPGAIKVPEQGYTKVPVPGYTKLPEPCPSTVTPGPAQQKTKQK

SEQ ID NO: 197 - protein, 815 aa, Homo sapiens
MEDGFSSYSSLYDTSSLLQFCNDDSASAASSMEVTDRIASLEQRVQMQEDDIQLLKSALADVVRRLNITEEQQAVLNRKGPTKARPLMQTLPLRTTVNNGTVLPKKPTGSLPSPSGVRKETAVPATKSNIKRTSSSERVSPGGRRESNGDSRGNRNRTGSTSSSSSGKKNSESKPKEPVFSAEEGYVKMFLRGRPVTMYMPKDQVDSYSLEAKVELPTKRLKLEWVYGYRGRDCRNNLYLLPTGETVYFIASVVVLYNVEEQLQRHYAGHNDDVKCLAVHPDRITIATGQVAGTSKDGKQLPPHVRIWDSVTLNTLHVIGIGFFDRAVTCIAFSKSNGGTNLCAVDDSNDHVLSVWDWQKEEKLADVKCSNEAVFAADFHPTDTNIIVTCGKSHLYFWTLEGSSLNKKQGLFEKQEKPKFVLCVTFSENGDTITGDSSGNILVWGKGTNRISYAVQGAHEGGIFALCMLRDGTLVSGGGKDRKLISWSGNYQKLRKTEIPEQFGPIRTVAEGKGDVILIGTTRNFVLQGTLSGDFTPITQGHTDELWGLAIHASKSQFLTCGHDKHATLWDAVGHRPVWDKIIEDPAQSSGFHPSGSVVAVGTLTGRWFVFDTETKDLVTVHTDGNEQLSVMRYSPDGNFLAIGSHDNCIYIYGVSDNGRKYTRVGKCSGHSSFITHLDWSVNSQFLVSNSGDYEILYWVPSACKQVVSVETTRDIEWATYTCTLGFHVFGVWPEGSDGTDINAVCRAHEKKLLSTGDDFGKVHLFSYPCSQFRAPSHIYGGHSSHVTNVDFLCEDSHLISTGGKDTSIMQWRVI

SEQ ID NO: 198 - protein, 121 aa, Homo sapiens
MGRIFLDHIGGTRLFSCANCDTILTNRSELISTRFTGATGRAFLFNKVVNLQYSEVQDRVMLTGRHMVRDVSCKNCNSKLGWIYEFATEDSQRYKEGRVILERALVRESEGFEEHVPSDNS

SEQ ID NO: 199 - protein, 120 aa, Homo sapiens
MSSSAGSGHQPSQSRAIPTRTVAISDAAQLPHDYCTTPGGTLFSTTPGGTRIIYDRKFLLDRRNSPMAQTPPCHLPNIPGVTSPGTLIEDSKVEVNNLNNLNNHDRKHAVGDDAQFEMDI

SEQ ID NO: 200 - protein, 497 aa, Homo sapiens
MDNRQNVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFLLINRKKEENATRILQRLWGTQDVSQDIQEMKDESARMSQEKQVTVLELFRVSSYRQPIIISIVLQLSQQLSGINAVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 201 - protein, 1529 aa, Homo sapiens
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSAKEQYFIPGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 202 - protein, 976 aa, Homo sapiens [sequence omitted]

SEQ ID NO: 203 - protein, 1151 aa, Homo sapiens
FNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLKRMDIGPKQTQVGIVQYGENVTHEFNLNKYSSTEEVLVAAKKIVQRGGRQTMTALGTDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFEVKLKSKEDTIYEADLQYRVTLDSLRQISRSFFSGTQERKVQRNITVRKSECTKHSFYMLDKHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVPLWVILLSAFAGLLLLMLLILALWKIGFFKRPLKKKMEK

SEQ ID NO: 204 - protein, 892 aa, Homo sapiens
MTDPFCVGGRRLPGSSKSGPGKDGSRKEVRLPMLHDPPKMGMPVVRGGQTVPGQAPLCFDPGSPASDKTEGKKKGRPKAENQALRDIPLSLMNDWKDEFKAHSRVKCPNSGCWLEFPSIYGLKYHYQRCQGGAISDRLAFPCPFCEAAFTSKTQLEKHRIWNHMDRPLPASKPGPISRPVTISRPVGVSKPIGVSKPVTIGKPVGVSKPIGISKPVSVGRPMPVTKAIPVTRPVPVTKPVTVSRPMPVTKAMPVTKPITVTKSVPVTKPVPVTKPITVTKLVTVTKPVPVTKPVTVSRPIVVSKPVTVSRPIAISRHTPPCKMVLLTRSENKAPRATGRNSGKKRAADSLDTCPIPPKQARPENGEYGPSSMGQSSAFQLSADTSSGSLSPGSRPSGGMEALKAAGPASPPEEDPERTKHRRKQKTPKKFTGEQPSISGTFGLKGLVKAEDKARVHRSKKQEGPGPEDARKKVPAAPITVSKEAPAPVAHPAPGGPEEQWQRAIHERGEAVCPTCNVVTRKTLVGLKKHMEVCQKLQDALKCQHCRKQFKSKAGLNYHTMAEHSAKPSDAEASEGGEQEERERLRKVLKQMGRLRCPQEGCGAAFSSLMGYQYHQRRCGKPPCEVDSPSFPCTHCGKTYRSKAGHDYHVRSEHTAPPPEEPTDKSPEAEDPLGVERTPSGRVRRTSAQVAVFHLQEIAEDELARDWTKRRMKDDLVPETARLNYTRPGLPTLNPQLLEAWKNEVKEKGHVNCPNDCCEAIYSSVSGLKAHLASCSKGAHLAGKYRCLLCPKEFSSESGVKYHILKTHAENWFRTSADPPPKHRSQDSLVPKKEKKKNLAGGKKRGRKPKERTPEEPVAKLPPRRDDWPPGCRDKGARGSTGRKVGVSKAPEK

SEQ ID NO: 205 - protein, 755 aa, Homo sapiens
MEPIDLSIPKNFRKGDKDLATPSEAKKPEEEAGSSEQPSPCPAPGPSLPVTLGPSGILESPMAPAPAATPEPPAQPLQGPVQLAVPIYSSALVSSPPLVGSSALLSGTALLRPLRPKPPLLLPKPPVTEELPPLASIAQIISSVSSAPTLLKTKVADPGPASTGSNTTASDSLGGSVPKAATTATPAATTSPKESSEPPAPASSPEAASPTEQGPARTSKKRGRKRGMRSRPRANSGGVDLDSSGEFASIEKMLATTDTNKFSPFLQTAEDNTQDEVAGAPADHHGPSDEEQGSPPEDKLLRAKRNSYTNCLQKITCPHCPRVFPWASSLQRHMLTHTDSQSDAETAAAAGEVLDLTSRDREQPSEGATELRQVAGDAPVEQATAETASPVHREEHGRGESHEPEEEHGTEESTGDADGGRGRVEQPEPGPGLRHQAHGLQAGGGRRRGRPGGAASQEQKLACDTCGKSFKFLGTLSRHRKAHGRQEPKDEKGDGATTAEEGPSPAPEQEEKPPETPAEVVESAPGAGEAPAEKLAEETEGPSDGESAAEKRSSEKSDDDKKPKTDSPKSVASKADKRKKVCSVCNKRFWSLQDLTRHMRSHTGERPYKCQTCERTFTLKHSLVRHQRIHQKARHAKHHGKDSDKEERGEEDSENESTHSGNNAVSENEAELAPNASNHMAVTRSRKEGLASATKDCSHREEKVTAGWPSEPGQGDLNPESPAALGQDLLEPRSKRPAHPILATADGASQHVGME

SEQ ID NO: 206 - protein, 1157 aa, Homo sapiens
MGKLRRRYNIKGRQQAGPGPSKGPPEPPPVQLELEDKDTLKGVDASNALVLPGKKKKKTKAPPLSKKEKKPLTKKEKKVLQKILEQKEKKSQRAEMLQKLSEVQASEAEMRLFYTTSKLGTGNRMYHTKEKADEVVAPGQEKISSLSGAHRKRRRWPSAEEEEEEEEESESELEEESELDEDPAAEPAEAGVGTTVAPLPPAPAPSSQPVPAGMTVPPPPAAAPPLPRALAKPAVFIPVNRSPEMQEERLKLPILSEEQVIMEAVAEHPIVIVCGETGSGKTTQVPQFLYEAGFSSEDSIIGVTEPRRVAAVAMSQRVAKEMNLSQRVVSYQIRYEGNVTEETRIKFMTDGVLLKEIQKDFLLLRYKVVIIDEAHERSVYTDILIGLLSRIVTLRAKRNLPLKLLIMSATLRVEDFTQNPRLFAKPPPVIKVESRQFPVTVHFNKRTPLEDYSGECFRKVCKIHRMLPAGGILVFLTGQAEVHALCRRLRKAFPPSRARPQEKDDDQKDSVEEMRKFKKSRARAKKARAEVLPQINLDHYSVLPAGEGDEDREAEVDEEEGALDSDLDLDLGDGGQDGGEQPDASLPLHVLPLYSLLAPEKQAQVFKPPPEGTRLCVVATNVAETSLTIPGIKYVVDCGKVKKRYYDRVTGVSSFRVTWVSQASADQRAGRAGRTEPGHCYRLYSSAVFGDFEQFPPPEITRRPVEDLILQMKALNVEKVINFPFPTPPSVEALLAAEELLIALGALQPPQKAERVKQLQENRLSCPITALGRTMATFPVAPRYAKMLALSRQHGCLPYAITIVASMTVRELFEELDRPAASDEELTRLKSKRARVAQMKRTWAGQGASLKLGDLMVLLGAVGACEYASCTPQFCEANGLRYKAMMEIRRLRGQLTTAVNAVCPEAELFVDPKMQPPTESQVTYLRQIVTAGLGDHLARRVQSEEMLEDKWRNAYKTPLLDDPVFIHPSSVLFKELPEFVVYQEIVETTKMYMKGVSSVEVQWIPALLPSYCQFDKPLEEPAPTYCPERGRVLCHRASVFYRVGWPLPAIEVDFPEGIDRYKHFARFLLEGQVFRKLASYRSCLLSSPGTMLKTWARLQPRTESLLRALVAEKADCHEALLAAWKKNPKYLLAEYCEWLPQAMHPDIEKAWPPTTVH

SEQ ID NO: 207 - protein, 105 aa, Homo sapiens
QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 208 - protein, 897 aa, Homo sapiens
MEQLADVTLRRLLDNEVFDLDPDLQEPSQITKRDLEARAQNEFFRAFFRLPRKEKLHAVVDCSLWTPFSRCHTAGRMFASDSYICFASREDGCCKIILPLREVVSIEKMEDTSLLPHPIIVSIRSKVAFQFIELRDRDSLVEALLARLKQVHANHPVHYDTSADDDMASLVFHSTSMCSDHRFGDLEMMSSQNSEESEKEKSPLMHPDALVTAFQQSGSQSPDSRMSREQIKISLWNDHFVEYGRTVCMFRTEKIRKLVAMGIPESLRGRLWLLFSDAVTDLASHPGYYGNLVEESLGKCCLVTEEIERDLHRSLPEHPAFQNETGIAALRRVLTAYAHRNPKIGYCQSMNILTSVLLLYTKEEEAFWLLVAVCERMLPDYFNHRVIGAQVDQSVFEELIKGHLPELAEHMNDLSALASVSLSWFLTLFLSIMPLESAVNVVDCFFYDGIKAIFQLGLAVLEANAEDLCSSKDDGQALMILSRFLDHIKNEDSPGPPVGSHHAFFSDDQEPYPVTDISDLIRDSYEKFGDQSVEQIEHLRYKHRIRVLQGHEDTTKQNVLRVVIPEVSILPEDLEELYDLFKREHMMSCYWEQPRPMASRHDPSRPYAEQYRIDARQFAHLFQLVSPWTCGAHTEILAERTFRLLDDNMDQLIEFKAFVSCLDIMYNGEMNEKIKLLYRLHIPPALTENDRDSQSPLRNPLLSTSRPLVFGKPNGDAVDYQKQLKQMIKDLAKEKDKTEKELPKMSQREFIQFCKTLYSMFHEDPEENDLYQAIATVTTLLLQIGEVGQRGSSSGSCSQECGEELRASAPSPEDSVFADTGKTPQDSQALPEAAERDWTVSLEHILASLLTEQSLVNFFEKPLDMKSKLENAKINQYNLKTFEMSHQSQSELKLSNL

SEQ ID NO: 209 - protein, 1209 aa, Homo sapiens
MTVPKEMPEKWARAQAPPSWSRKKPSWGTEEERRARANDREYNEKFQYASNCIKTSKYNILTFLPVNLFEQFQEVANTYFLFLLILQLIPQISSLSWFTTIVPLVLVLTITAVKDATDDYFRHKSDNQVNNRQSQVLINGILQQEQWMNVCVGDIIKLENNQFVAADLLLLSSSEPHGLCYIETAELDGETNMKVRQAIPVTSELGDISKLAKFDGEVICEPPNNKLDKFSGTLYWKENKFPLSNQNMLLRGCVLRNTEWCFGLVIFAGPDTKLMQNSGRTKFKRTSIDRLMNTLVLWIFGFLVCMGVILAIGNAIWEHEVGMRFQVYLPWDEAVDSAFFSGFLSFWSYIIILNTVVPISLYVSVEVIRLGHSYFINWDKKMFCMKKRTPAEARTTTLNEELGQVEYIFSDKTGTLTQNIMVFNKCSINGHSYGDVFDVLGHKAELGERPEPVDFSFNPLADKKFLFWDPSLLEAVKIGDPHTHEFFRLLSLCHTVMSEEKNEGELYYKAQSPDEGALVTAARNFGFVFRSRTPKTITVHEMGTAITYQLLAILDFNNIRKRMSVIVRNPEGKIRLYCKGADTILLDRLHHSTQELLNTTMDHLNEYAGEGLRTLVLAYKDLDEEYYEEWAERRLQASLAQDSREDRLASIYEEVENNMMLLGATAIEDKLQQGVPETIALLTLANIKIWVLTGDKQETAVNIGYSCKMLTDDMTEVFIVTGHTVLEVREELRKAREKMMDSSRSVGNGFTYQDKLSSSKLTSVLEAVAGEYALVINGHSLAHALEADMELEFLETACACKAVICCRVTPLQKAQVVELVKKYKKAVTLAIGDGANDVSMIKTAHIGVGISGQEGIQAVLASDYSFSQFKFLQRLLLVHGRWSYLRMCKFLCYFFYKNFAFTMVHFWFGFFCGFSAQTVYDQYFITLYNIVYTSLPVLAMGVFDQDVPEQRSMEYPKLYEPGQLNLLFNKREFFICIAQGIYTSVLMFFIPYGVFADATRDDGTQLADYQSFAVTVATSLVIVVSVQIGLDTGYWTAINHFFIWGSLAVYFAILFAMHSNGLFDMFPNQFRFVGNAQNTLAQPTVWLTIVLTTVVCIMPVVAFRFLRLNLKPDLSDTVRYTQLVRKKQKAQHRCMRRVGRTGSRRSGYAFSHQEGFGELIMSGKNMRLSSLALSSFTTRSSSSWIESLRRKKSDSASSPSGGADKPLKG

SEQ ID NO: 210 - protein, 847 aa, Homo sapiens
MAKPLTDQEKRRQISIRGIVGVENVAELKKSFNRHLHFTLVKDRNVATTRDYYFALAHTVRDHLVGRWIRTQQHYYDKCPKRVYYLSLEFYMGRTLQNTMINLGLQNACDEAIYQLGLDIEELEEIEEDAGLGNGGLGRLAACFLDSMATLGLAAYGYGIRYEYGIFNQKIRDGWQVEEADDWLRYGNPWEKSRPEFMLPVHFYGKVEHTNTGTKWIDTQVVLALPYDTPVPGYMNNTVNTMRLWSARAPNDFNLRDFNVGDYIQAVLDRNLAENISRVLYPNDNFFEGKELRLKQEYFVVAATLQDIIRRFKASKFGSTRGAGTVFDAFPDQVAIQLNDTHPALAIPELMRIFVDIEKLPWSKAWELTQKTFAYTNHTVLPEALERWPVDLVEKLLPRHLEIIYEINQKHLDRIVALFPKDVDRLRRMSLIEEEGSKRINMAHLCIVGSHAVNGVAKIHSDIVKTKVFKDFSELEPDKFQNKTNGITPRRWLLLCNPGLAELIAEKIGEDYVKDLSQLTKLHSFLGDDVFLRELAKVKQENKLKFSQFLETEYKVKINPSSMFDVQVKRIHEYKRQLLNCLHVITMYNRIKKDPKKLFVPRTVIIGGKAAPGYHMAKMIIKLITSVADVVNNDPMVGSKLKVIFLENYRVSLAEKVIPATDLSEQISTAGTEASGTGNMKFMLNGALTIGTMDGANVEMAEEAGEENLFIFGMRIDDVAALDKKGYEAKEYYEALPELKLVIDQIDNGFFSPKQPDLFKDIINMLFYHDRFKVFADYEAYVKCQDKVSQLYMNPKAWNTMVLKNIAASGKFSSDRTIKEYAQNIWNVEPSDLKISLSNESNKVNGN

SEQ ID NO: 211 - protein, 1030 aa, Homo sapiens
MKIPNIGNVMNKFEILGVVGEGAYGVVLKCRHKETHEIVAIKKFKDSEENEEVKETTLRELKMLRTLKQENIVELKEAFRRRGKLYLVFEYVEKNMLELLEEMPNGVPPEKVKSYIYQLIKAIHWCHKNDIVHRDIKPENLLISHNDVLKLCDFGFARNLSEGNNANYTEYVATRWYRSPELLLGAPYGKSVDMWSVGCILGELSDGQPLFPGESEIDQLFTIQKVLGPLPSEQMKLFYSNPRFHGLRFPAVNHPQSLERRYLGILNSVLLDLMKNLLKLDPADRYLTEQCLNHPTFQTQRLLDRSPSRSAKRKPYHVESSTLSNRNQAGKSTALQSHHRSNSKDIQNLSVGLPRADEGLPANESFLNGNLAGASLSPLHTKTYQASSQPGSTSKDLTNNNIPHLLSPKEAKSKTEFDFNIDPKPSEGPGTKYLKSNSRSQQNRHSFMESSQSKAGTLQPNEKQSRHSYIDTIPQSSRSPSYRTKAKSHGALSDSKSVSNLSEARAQIAEPSTSRYFPSSCLDLNSPTSPTPTRHSDTRTLLSPSGRNNRNEGTLDSRRTTTRHSKTMEELKLPEHMDSSHSHSLSAPHESFSYGLGYTSPFSSQQRPHRHSMYVTRDKVRAKGLDGSLSIGQGMAARANSLQLLSPQPGEQLPPEMTVARSSVKETSREGTSSFHTRQKSEGGVYHDPHSDDGTAPKENRHLYNDPVPRRVGSFYRVPSPRPDNSFHENNVSTRVSSLPSESSSGTNHSKRQPAFDPWKSPENISHSEQLKEKEKQGFFRSMKKKKKKSQTVPNSDSPDLLTLQKSIHSASTPSSRPKEWRPEKISDLQTQSQPLKSLRKLLHLSSASNHPASSDPRFQPLTAQQTKNSFSEIRIHPLSQASGGSSNIRQEPAPKGRPALQLPDGGCDGRRQRHHSGPQDRRFMLRTTEQQGEYFCCGDPKKPHTPCVPNRALHRPISSPAPYPVLQVRGTSMCPTLQVRGTDAFSCPTQQSGFSFFVRHVMREALIHRAQVNQAALLTYHENAALTGK

SEQ ID NO: 212 - protein, 519 aa, Homo sapiens
MAAEREPPPLGDGKPTDFEDLEDGEDLFTSTVSTLESSPSSPEPASLPAEDISANSNGPKPTEVVLDDDREDLFAEATEEVSLDSPEREPILSSEPSPAVTPVTPTTLIAPRIESKSMSAPVIFDRSREEIEEEANGDIFDIEIGVSDPEKVGDGMNAYMAYRVTTKTSLSMFSKSEFSVKRRFSDFLGLHSKLASKYLHVGYIVPPAPEKSIVGMTKVKVGKEDSSSTEFVEKRRAALERYLQRTVKHPTLLQDPDLRQFLESSELPRAVNTQALSGAGILRMVNKAADAVNKMTIKMNESDAWFEEKQQQFENLDQQLRKLHVSVEALFCHRKELSANTAAFAKSAAMLGNSEDHTALSRALSQLAEVEEKIDQLHQEQAFSDFYMFSELLSDYIRLIAAVKGVFDHRMKCWQKWEDAQITLLKKREAEAKMMVANKPDKIQQAKNEIREWEAKVQQGERDFEQISKTIRKEVGRFEKERVKDFKTVIIKYLESLVQTQQQLIKYWEAFLPEAKAIA

SEQ ID NO: 213 - protein, 858 aa, Homo sapiens
MAAKGAHGSYLKVESELERCRAEGHWDRMPELVRQLQTLSMPGGGGNRRGSPSAAFTFPDTDDFGKLLLAEALLEQCLKENHAKIKDSMPLLEKNEPKMSEAKNYLSSILNHGRLSPQYMCEAMLILGKLHYVEGSYRDAISMYARAGIDDMSMENKPLYQMRLLSEAFVIKGLSLERLPNSIASRFRLTEREEEVITCFERASWIAQVFLQELEKTTNNSTSRHLKGCHPLDYELTYFLEAALQSAYVKNLKKGNIVKGMRELREVLRTVETKATQNFKVMAAKHLAGVLLHSLSEECYWSPLSHPLPEFMGKEESSFATQALRKPHLYEGDNLYCPKDNIEEALLLLLISESMATRDVVLSRVPEQEEDRTVSLQNAAAIYDLLSITLGRRGQYVMLSECLERAMKFAFGEFHLWYQVALSMVACGKSAYAVSLLRECVKLRPSDPTVPLMAAKVCIGSLRWLEEAEHFAMMVISLGEEAGEFLPKGYLALGLTYSLQATDATLKSKQDELHRKALQTLERAQQLAPSDPQVILYVSLQLALVRQISSAMEQLQEALKVRKDDAHALHLLALLFSAQKHHQHALDVVNMAITEHPENFNLMFTKVKLEQVLKGPEEALVTCRQVLRLWQTLYSFSQLGGLEKDGSFGEGLTMKKQSGMHLTLPDAHDADSGSRRASSIAASRLEEAMSELTMPSSVLKQGPMQLWTTLEQIWLQAAELFMEQQHLKEAGFCIQEAAGLFPTSHSVLYMRGRLAEVKGNLEEAKQLYKEALTVNPDGVRIMHSLGLMLSRLGHKSLAQKVLRDAVERQSTCHEAWQGLGEVLQAQGQNEAAVDCFLTALELEASSPVLPFSIIPREL

SEQ ID NO: 214 - protein, 484 aa, Homo sapiens
MAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTDLIILRNALDLLLPKLARVISRLADFAKERASLPTLGFTHFQPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMTLVMDPLQTASVQWFERTLDDSANRRICLAEAFLTADTILNTLQNISEGLVVYPKVIERRIRQELPFMATENIIMAMVKAGGSRQDCHEKIRVLSQQAASVVKQEGGDNDLIERIQVDAYFSPIHSQLDHLLDPSSFTGRASQQVQRFLEEEVYPLLKPYESVMKVKAELCL

SEQ ID NO: 215 - protein, 1371 aa, Homo sapiens
AGCGGLARLSVPCWRIWPQRAAKIAGPGRKRRSPDPDAVADPGALWLSTKRLKMSGGASATGPRRGPPGLEDTTSKKKQKDRANQESKDGDPRKETGSRYVAQAGLEPLASGDPSASASHAAGITGSRHRTRLFFPSSSGSASTPQEEQTKEGACEDPHDLLATPTPELLLDWRQSAEEVIVKLRVGVGPLQLEDVDAAFTDTDCVVRFAGGQQWGGVFYAEIKSSCAKVQTRKGSLLHLTLPKKVPMLTWPSLLVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQASRIWQELEAEEEPVPEGSGPLGPWGPQDWVGPLPRGPTTPDEGCLRYFVLGTVAALVALVLNVFYPLVSQSRWR

SEQ ID NO: 216 - protein, 1325 aa, Homo sapiens
MLPVYQEVKPNPLQDANICSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQTLLQVVGVVSVAVAVIPWIAIPLVPLGIIFIFLRRYFLETSRDVKRLESTTRSPVFSHLSSSLQGLWTIRAYKAEERCQELFDAHQDLHSEAWFLFLTTSRWFAVRLDAICAMFVIIVAFGSLILAKTLDAGQVGLALSYALTLMGMFQWCVRQSAEVENMMISVERVIEYTDLEKEAPWEYQKRPPPAWPHEGVIIFDNVNFMYSPGGPLVLKHLTALIKSQEKVGIVGRTGAGKSSLISALFRLSEPEGKIWIDKILTTEIGLHDLRKKMSIIPQEPVLFTGTMRKNLDPFKEHTDEELWNALQEVQLKETIEDLPGKMDTELAESGSNFSVGQRQLVCLARAILRKNQILIIDEATANVDPRTDELIQKKIREKFAHCTVLTIAHRLNTIIDSDKIMVLDSGRLKEYDEPYVLLQNKESLFYKMVQQLGKAEAAALTETAKQVYFKRNYPHIGHTDHMVTNTSNGQPSTLTIFETAL

SEQ ID NO: 217 - protein, 680 aa, Homo sapiens
MESSSSSNSYFSVGPTSPSAVVLLYSKELKKWDEFEDILEERRHVSDLKFAMKCYTPLVYKGITPCKPIDIKCSVLNSEEIHYVIKQLSKESLQSVDVLREEVSEILDEMSHKLRLGAIRFCAFTLSKVFKQIFSKVCVNEEGIQKLQRAIQEHPVVLLPSHRSYIDFLMLSFLLYNYDLPVPVIAAGMDFLGMKMVGELLRMSGAFFMRRTFGGNKLYWAVFSEYVKTMLRNGYAPVEFFLEGTRSRSAKTLTPKFGLLNIVMEPFFKREVFDTYLVPISISYDKILEETLYVYELLGVPKPKESTTGLLKARKILSENFGSIHVYFGDPVSLRSLAAGRMSRSSYNLVPRYIPQKQSEDMHAFVTEVAYKMELLQIENMVLSPWTLIVAVLLQNRPSMDFDALVEKTLWLKGLTQAFGGFLIWPDNKPAEEVVPASILLHSNIASLVKDQVILKVDSGDSEVVDGLMLQHITLLMCSAYRNQLLNIFVRPSLVAVALQMTPGFRKEDVYSCFRFLRDVFADEFIFLPGNTLKDFEEGCYLLCKSEAIQVTTKDILVTEKGNTVLEFLVGLFKPFVESYQIICKYLLSEEEDHFSEEQYLAAVRKFTSQLLDQGTSQCYDVLSSDVQKNALAACVRLGVVEKKKINNNCIFNVNEPATTKLEEMLGCKTPIGKPATAKL

SEQ ID NO: 218 - protein, 1142 aa, Homo sapiens
MPEAKPAAKKAPKGKDAPKGAPKEAPPKEAPAEAPKEAPPEDQSPTAEEPTGVFLKKPDSVSVETGKDAVVVAKVNGKELPDKPTIKWFKGKWLELGSKSGARFSFKESHNSASNVYTVELHIGKVVLGDRGYYRLEVKAKDTCDSCGFNIDVEAPRQDASGQSLESFKRTSEKKSDTAGELDFSGLLKKREVVEEEKKKKKKDDDDLGIPPEIWELLKGAKKSEYEKIAFQYGITDLRGMLKRLKKAKVEVKKSAAFTKKLDPAYQVDRGNKIKLMVEISDPDLTLKWFKNGQEIKPSSKYVFENVGKKRILTINKCTLADDAAYEVAVKDEKCFTELFVKEPPVLIVTPLEDQQVFVGDRVEMAVEVSEEGAQVMWMKDGVELTREDSFKARYRFKKDGKRHILIFSDVVQEDRGRYQVITNGGQCEAELIVEEKQLEVLQDIADLTVKASEQAVFKCEVSDEKVTGKWYKNGVEVRPSKRITISHVGRFHKLVIDDVRPEDEGDYTFVPDGYALGSLSAKLNFLEIKVEYVPKQEPPKIHLDCSGKTSENAIVVVAGNKLRLDVSITGEPPPVATWLKGDEVFTTTEGRTRIEKRVDCSSFVIESAQREDEGRYTIKVTNPVGEDVASIFLQVVDVPDPPEAVRITSVGEDWAILVWEPPMYDGGKPVTGYLVERKKKGSQRWMKLNFEVFTETTYESTKMIEGILYEMRVFAVNAIGVSQPSMNTKPFMPIAPTSEPLHLIVEDVTDTTTTLKWRPPNRIGAGGIDGYLVEYCLEGSEEWVPANTEPVERCGFTVKNLPTGARILFRVVGVNIAGRTEPATLAQPVTIREIAEPPKIRLPRHLRQTYIRKVGEQLNLVVPFQGKPRPQVVWTKGGAPLDTSRVHVRTSDFDTVFFVRQAARSDSGEYELSVQIENMKDTATIRIRVVEKAGPPINVMVKEVWGTNALVEWQAPKDDGNSEIMGYFVQKADKKTMEWFNVYERNRHTSCTVSDLIVGNEYYFRVYTENICGLSDSPGVSKNTARILKTGITFKPFEYKEHDFRMAPKFLTPLIDRVVVAGYSAALNCAVRGHPKPKVVWMKNKMEIREDPKFLITNYQGVLTLNIRRPSPFDAGTYTCRAVNELGEALAECKLEVRVPQ

SEQ ID NO: 219 - protein, 1161 aa, Homo sapiens
MKKFSRMPKSEGGSGGGAAGGGAGGAGAGAGCGSGGSSVGVRVFAVGRHQVTLEESLAEGGFSTVFLVRTHGGIRCALKRMYVNNMPDLNVCKREITIMKELSGHKNIVGYLDCAVNSISDNVWEVLILMEYCRAGQVVNQMNKKLQTGFTEPEVLQIFCDTCEAVARLHQCKTPIIHRDLKVENILLNDGGNYVLCDFGSATNKFLNPQKDGVNVVEEEIKKYTTLSYRAPEMINLYGGKPITTKADIWALGCLLYKLCFFTLPFGESQVAICDGNFTIPDNSRYSRNIHCLIRFMLEPDPEHRPDIFQVSYFAFKFAKKDCPVSNINNSSIPSALPEPMTASEAAARKSQIKARITDTIGPTETSIAPRQRPKANSATTATPSVLTIQSSATPVKVLAPGEFGNHRPKGALRPGNGPEILLGQGPPQQPPQQHRVLQQLQQGDWRLQQLHLQHRHPHQQQQQQQQQQQQQQQQQQQQQQQQQQQHHHHHHHHLLQDAYMQQYQHATQQQQMLQQQFLMHSVYQPQPSASQYPTMMPQYQQAFFQQQMLAQHQPSQQQASPEYLTSPQEFSPALVSYTSSLPAQVGTIMDSSYSANRSVADKEAIANFTNQKNISNPPDMSGWNPFGEDNFSKLTEEELLDREFDLLRSNRLEERASSDKNVDSLSAPHNHPPEDPFGSVPFISHSGSPEKKAEHSSINQENGTANPIKNGKTSPASKDQRTGKKTSVQGQVQKGNDESESDFESDPPSPKSSEEEEQDDEEVLQGEQGDFNDDDTEPENLGHRPLLMDSEDEEEEEKHSSDSDYEQAKAKYSDMSSVYRDRSGSGPTQDLNTILLTSAQLSSDVAVETPKQEFDVFGAVPFFAVRAQQPQQEKNEKNLPQHRFPAAGLEQEEFDVFTKAPFSKKVNVQECHAVGPEAHTIPGYPKSVDVFGSTPFQPFLTSTSKSESNEDLFGLVPFDEITGSQQQKVKQRSLQKLSSRQRRTKQDMSKSNGKRHHGTPTSTKKTLKPTYRTPERARRHKKVGRRDSQSSNEFLTISDSKENISVALTDGKDRGNVLQPEESLLDPFGAKPFHSPDLSWHPPHQGLSDIRADHNTVLPGRPRQNSLHGSFHSADVLKMDDFGAVPFTELVVQSITPHQSQQSQPVELDPFGAAPFPSKQ

SEQ ID NO: 220 - protein, 520 aa, Homo sapiens
MAALKLLSSGLRLCASARGSGATWYKGCVCSFSTSAHRHTKFYTDPVEAVKDIPDGATVLVGGFGLCGIPENLIDALLKTGVKGLTAVSNNAGVDNFGLGLLLRSKQIKRMVSSYVGENAEFERQYLSGELEVELTPQGTLAERIRAGGAGVPAFYTPTGYGTLVQEGGSPIKYNKDGSVAIASKPREVREFNGQHFILEEAITGDFALVKAWKADRAGNVIFRKSARNFNLPMCKAAETTVVEVEEIVDIGAFAPEDIHIPQIYVHRLIKGEKYEKRIERLSIRKEGDGEAKSAKPGDDVRERIIKRAALEFEDGMYANLGIGIPLLASNFISPNITVHLQSENGVLGLGPYPRQHEADADLINAGKETVTILPGASFFSSDESFAMIRGGHVDLTMLGAMQVSKYGDLANWMIPGKMVKGMGGAMDLVSSAKTKVVVTMEHSAKGNAHKIMEKCTLPLTGKQCVNRIITEKAVFDVDKKKGLTLIELWEGLTVDDVQKSTGCDFAVSPKLMPMQQIAN

SEQ ID NO: 221 - protein, 1035 aa, Homo sapiens
MGGPAAPRGAGRLRALLLALVVAGIPAGAYNLDPQRPVHFQGPADSFFGYAVLEHFHDNTRWVLVGAPKADSKYSPSVKSPGAVFKCRVHTNPDRRCTELDMARGKNRGTSCGKTCREDRDDEWMGVSLARQPKADGRVLACAHRWKNIYYEADHILPHGFCYIIPSNLQAKGRTLIPCYEEYKKKYGEEHGSCQAGIAGFFTEELVVMGAPGSFYWAGTIKVLNLTDNTYLKLNDEVIMNRRYTYLGYAVTAGHFSHPSTIDVVGGAPQDKGIGKVYIFRADRRSGTLIKIFQASGKKMGSYFGSSLCAVDLNGDGLSDLLVGAPMFSEIRDEGQVTVYINRGNGALEEQLALTGDGAYNAHFGESIASLDDLDNDGFPDVAIGAPKEDDFAGAVYIYHGDAGGIVPQYSMKLSGQKINPVLRMFGQSISGGIDMDGNGYPDVTVGAFMSDSVVLLRARPVITVDVSIFLPGSINITAPQCHDGQQPVNCLNVTTCFSFHGKHVPEEIGLNYVLMADVAKKEKGQMPRVYFVLLGETMGQVTEKLQLTYMEETCRHYVAHVKRRVQDVISPIVFEAAYSLSEHVTGEEERELPPLTPVLRWKKGQKIAQKNQTVFERNCRSEDCAADLQLQGKLLLSSMDEKTLYLALGAVKNISLNISISNLGDDAYDANVSFNVSRELFFINMWQKEEMGISCELLESDFLKCSVGFPFMRSKSKYEFSVIFDTSHLSGEEEVLSFIVTAQSGNTERSESLHDNTLVLMVPLMHEVDTSITGIMSPTSFVYGESVDAANFIQLDDLECHFQPINITLQVYNTGPSTLPGSSVSISFPNRLSSGGAEMFHVQEMVVGQEKGNCSFQKNPTPCIIPQEQENIFHTIFAFFTKSGRKVLDCEKPGISCLTAHCNFSALAKEESRTIDIYMLLNTEILKKDSSSVIQFMSRAKVKVDPALRVVEIAHGNPEEVTVVFEALHNLEPRGYVVGWIIAISLLVGILIFLLLAVLLWKMGFFRRRYKEIIEAEKNRKENEDSWDWVQKNQ

SEQ ID NO: 222 - protein, 599 aa, Homo sapiens
MDGSRRVRATSVLPRYGPPCLFKGHLSTKSNAFCTDSSSLRLSTLQLVKNHMAVHYNKILSAKAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSVKQNDVDMLNVFDFEKAGNSEPNELKNESEVTIQQERQQYQKALDMLLSAPKDENEIFPSPTEFFMPIYKSKHSEGVIIQQVNDETNLETSTLDENHPSISDSLTDRETSVNVIEGDSDPEKVEISNGLCGLNTSPSQSVQFSSVKGDNNHDMELSTLKIMEMSIEDCPLDV

SEQ ID NO: 223 - protein, 739 aa, Homo sapiens
MEPKPATKNATRTKAISEDLSQEAILEKLTENGLWDSRMEGLWKWNDRILRLQNNQENHLSQRIIPLKKTPTSQRGFRFESILIPEPGIATEELHSRCQTQEENFTENLNLITDTHLGKIICKEMKGSKAIRQTSELTLGKKSNNKEKPYKCSTCEKAFHYRSLLIQHQRTHTKEKPYECNECGKTFSQPSYLSQHKKIHTGEKPYKCNECGKAFIASSSLMVHQRIHTKEKPYQCNVCGKSFSQCARLNQHQRIQTGEKPYKCSECGKAFSDKSKLARHQETHNGEKPYKCDDCGKAFRNKSYLSVHQKTHTEEKPYQCNECGKSFKNTTIFNVHQRIHTGEKPFRCNECGKAYRSNSSLIVHIRTHTGEKPYECNECGKAFNRIANFTEHQRIHTGEKPYKCNECGKAFINYSCLTVHHRMHTGEKPYKCTECGKAFMRSSSLIIHQRIHTEEKPYLCNECGESFRIKSHLTVHQRIHTGEKPYKCTDCERAFTKMVNLKEHQKIHTGVKPYKCYDCGKSFRTKSYLIVHQRTHTGEKPYKCNECEKAFTNTSQLTVHQRRHTGEKPYKCNECGKVFTSNSGFNTHQRTHTGEKPFKCNDCGKAFSQMVHVTEHQKIHSGEKPYKCDVCGKAFRRGSYLTVHWRTHTGEKPYTCKECGKGCITLSQLTLHQRIHTGERPYKCEECGKAFRTNSDFTVHLRMHTGEKPYKCNECGKAFRSSSSLTVHQRIHQRETQLI

SEQ ID NO: 224 - protein, 913 aa, Homo sapiens
MGDSRDLCPHLDSIGEVTKEDLLLKSKGTCQSCGVTGPNLWACLQVACPYVGCGESFADHSTIHAQAKKHNLTVNLTTFRLWCYACEKEVFLEQRLAAPLLGSSSKFSEQDSPPPSHPLKAVPIAVADEGESESEDDDLKPRGLTGMKNLGNSCYMNAALQALSNCPPLTQFFLECGGLVRTDKKPALCKSYQKLVSEVWHKKRPSYVVPTSLSHGIKLVNPMFRGYAQQDTQEFLRCLMDQLHEELKEPVVATVALTEARDSDSSDTDEKREGDRSPSEDEFLSCDSSSDRGEGDGQGRGGGSSQAETELLIPDEAGRVISEKERMKDRKFSWGQQRTNSEQVDEDADVDTAMAALDQPAEAQPPSPRSSSPCRTPEPDNDAHLRSSSRPCSPVHHHEGHAKLSSSPPRASPVRMAPSYVLKKAQVLSAGSRRRKEQRYRSVISDIFDGSILSLVQCLTCDRVSTTVETFQDLSLPIPGKEDLAKLHSAIYQNVPAKPGACGDSYAAQGWLAFIVEYIRRFVVSCTPSWFWGPVVTLEDCLAAFFAADELKGDNMYSCERCKKLRNGVKYCKVLRLPEILCIHLKRFRHEVMYSFKINSHVSFPLEGLDLRPFLAKECTSQITTYDLLSVICHHGTAGSGHYIAYCQNVINGQWYEFDDQYVTEVHETVVQNAEGYVLFYRKSSEEAMRERQQVVSLAAMREPSLLRFYVSREWLNKFNTFAEPGPITNQTFLCSHGGIPPHKYHYIDDLVVILPQNVWEHLYNRFGGGPAVNHLYVCSICQVEIEALAKRRRIEIDTFIKLNKAFQAEESPGVIYCISMQWFREWEAFVKGKDNEPPGPIDNSRIAQVKGSGHVQLKQGADYGQISEETWTYLNSLYGGGPEIAIRQSVAQPLGPENLHGEQKIEAETRAV

SEQ ID NO: 225 - protein, 415 aa, Homo sapiens
MLWSGCRRFGARLGCLPGGLRVLVQTGHRSLTSCIDPSMGLNEEQKEFQKVAFDFAAREMAPNMAEWDQKELFPVDVMRKAAQLGFGGVYIQTDVGGSGLSRLDTSVIFEALATGCTSTTAYISIHNMCAWMIDSFGNEEQRHKFCPPLCTMEKFASYCLTEPGSGSDAASLLTSAKKQGDHYILNGSKAFISGAGESDIYVVMCRTGGPGPKGISCIVVEKGTPGLSFGKKEKKVGWNSQPTRAVIFEDCAVPVANRIGSEGQGFLIAVRGLNGGRINIASCSLGAAHASVILTRDHLNVRKQFGEPLASNQYLQFTLADMATRLVAARLMVRNAAVALQEERKDAVALCSMAKLFATDECFAICNQALQMHGGYGYLKDYAVQQYVRDSRVHQILEGSNEVMRILISRSLLQE

SEQ ID NO: 226 - protein, 763 aa, Homo sapiens
MAATGTAAAAATGRLLLLLLVGLTAPALALAGYIEALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVGEFVSDVLLVPEKCQFFHKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCGGNRNNFESEDYCMAVCKAMIPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEDTQPELYHPMKKGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 227 - protein, 633 aa, Homo sapiens
MANQVNGNAVQLKEEEEPMDTSSVTHTEHYKTLIEAGLPQKVAERLDEIFQTGLVAYVDLDERAIDALREFNEEGALSVLQQFKESDLSHVQNKSAFLCGVMKTYRQREKQGSKVQESTKGPDEAKIKALLERTGYTLDVTTGQRKYGGPPPDSVYSGVQPGIGTEVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 228 - protein, 128 aa, Homo sapiens
MGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 229 - protein, 670 aa, Homo sapiens
MSHLPMKLLRKKIEKRNLKLRQRNLKFQGASNLTLSETQNGDVSEETMGSRKVKKSKQKPMNVGLSETQNGGMSQEAVGNIKVTKSPQKSTVLTNGEAAMQSSNSESKKKKKKKRKMVNDAEPDTKKAKTENKGKSEEESAETTKETENNVEKPDNDEDESEVPSLPLGLTGAFEDTSFASLCNLVNENTLKAIKEMGFTNMTEIQHKSIRPLLEGRDLLAAAKTGSGKTLAFLIPAVELIVKLRFMPRNGTGVLILSPTRELAMQTFGVLKELMTHHVHTYGLIMGGSNRSAEAQKLGNGINIIVATPGRLLDHMQNTPGFMYKNLQCLVIDEADRILDVGFEEELKQIIKLLPTRRQTMLFSATQTRKVEDLARISLKKEPLYVGVDDDKANATVDGLEQGYVVCPSEKRFLLLFTFLKKNRKKKLMVFFSSCMSVKYHYELLNYIDLPVLAIHGKQKQNKRTTTFFQFCNADSGTLLCTDVAARGLDIPEVDWIVQYDPPDDPKEYIHRVGRTARGLNGRGHALLILRPEELGFLRYLKQSKVPLSEFDFSWSKISDIQSQLEKLIEKNYFLHKSAQEAYKSYIRAYDSHSLKQIFNVNNLNLPQVALSFGFKVPPFVDLNVNSNEGKQKKRGGGGGFGYQKTKKVEKSKIFKHISKKSSDSRQFSH

SEQ ID NO: 230 - protein, 760 aa, Homo sapiens
MAGQQFQYDDSGNTFFYFLTSFVGLIVIPATYYLWPRDQNAEQIRLKNIRKVYGRCMWYRLRLLKPQPNIIPTVKKIVLLAGWALFLFLAYKVSKTDREYQEYNPYEVLNLDPGATVAEIKKQYRLLSLKYHPDKGGDEVMFMRIAKAYAALTDEESRKNWEEFGNPDGPQATSFGIALPAWIVDQKNSILVLLVYGLAFMVILPVVVGSWWYRSIRYSGDQILIRTTQIYTYFVYKTRNMDMKRLIMVLAGASEFDPQYNKDATSRPTDNILIPQLIREIGSINLKKNEPPLTCPYSLKARVLLLSHLARMKIPETLEEDQQFMLKKCPALLQEMVNVICQLIVMARNREEREFRAPTLASLENCMKLSQMAVQGLQQFKSPLLQLPHIEEDNLRRVSNHKKYKIKTIQDLVSLKESDRHTLLHFLEDEKYEEVMAVLGSFPYVTMDIKSQVLDDEDSNNITVGSLVTVLVKLTRQTMAEVFEKEQSICAAEEQPAEDGQGETNKNRTKGGWQQKSKGPKKTAKSKKKKPLKKKPTPVLLPQSKQQKQKQANGVVGNEAAVKEDEEEVSDKGSDSEEEETNRDSQSEKDDGSDRDSDREQDEKQNKDDEAEWQELQQSIQRKERALLETKSKITHPVYSLYFPEEKQEWWWLYIADRKEQTLISMPYHVCTLKDTEEVELKFPAPGKPGNYQYTVFLRSDSYMGLDQIKPLKLEVHEAKPVPENHPQWDTAIEGDEDQEDSEGFEDSFEEEEEEEEDDD

SEQ ID NO: 231 - protein, 981 aa, Homo sapiens
MVHHSGSIQSFKQQKGMNISKSEITKETSLKPSRRSLPCLAQSYAYSKSLSQSTSLFQSTESESQAPTSITLISTDKAEQVNTEENKNDSVLRCSFADLSDFCLALGKDKDYTDESEHATYDRSRLINDFVIKDKSEFKTKLSKNDMNYIASSGPLFKDGKRRIDYILVYRKTNIPYDKRNTFEKNLRAEGLMLEKEPAIASPDIMFIKIHIPWDTLCKYAERLNIRMPFRKKCYYTDGRSKSMGRMQTYFRRIKDWMAQNPMVLDKSAFPDLEESDCYTGPFSRARIHHFIINNKDTFFSNATRSRIVYHMLERTKYENGISKVGIRKLINNGSYIAAFPPHEGAYKSSQPIKTHGPQNNRHLLYERWARWGMWYKHQPLDLIRLYFGEKIGLYFAWLGWYTGMLIPAAIVGLCVFFYGLFTMNNSQVSQEICKATEVFMCPLCDKNCSLQRLNDSCIYAKVTYLFDNGGTVFFAIFMAIWATVFLEFWKRRRSILTYTWDLIEWEEEEETLRPQFEAKYYKMEIVNPITGKPEPHQPSSDKVTRLLVSVSGIFFMISLVITAVFGVVVYRLVVMEQFASFKWNFIKQYWQFATSAAAVCINFIIIMLLNLAYEKIAYLLTNLEYPRTESEWENSFALKMFLFQFVNLNSSIFYIAFFLGRFVGHPGKYNKLFDRWRLEECHPSGCLIDLCLQMGVIMFLKQIWNNFMELGYPLIQNWWSRHKIKRGIHDASIPQWENDWNLQPMNLHGLMDEYLEMVLQFGFTTIFVAAFPLAPLLALLNNIIEIRLDAYKFVTQWRRPLPARATDIGIWLGILEGIGILAVITNAFVIAITSDYIPRFVYEYKYGPCANHVEPSENCLKGYVNNSLSFFDLSELGMGKSGYCRYRDYRGPPWSSKPYEFTLQYWHILAARLAFIIVFEHLVFGIKSFIAYLIPDVPKGLHDRIRREKYLVQEMMYEAELEHLQQQRRKSGQPVHHEWP

SEQ ID NO: 232 - protein, 430 aa, Homo sapiens
MATLSVKPSRRFQLPDWHTNSYLLSTNAQLQRDASHQIRQEARVLRNETNNQTIWDEHDNRTRLVERIDTVNRWKEMLDKCLTDLDAEIDALTQMKESAEQNLQAKNLPLDVAIECLTLRESRRDIDVVKDPVEDELHKEVEVIEATKKALQQKVSQAFEQLCLLQEVQQQLNSDHRGKMETLEIDRGCLSLNLRSPNISLKVDPTRVPDGSTTLQQWDDFSRFNKDRAEAEMKAATELREATALTIAETNNELEAQRVATEFAFRKRLREMEKVYSELKWQEKNTLEEIAELQEDIRHLEEDLRTKLLSLKLSHTRLEARTYRPNVELCRDQAQYGLTDEVHQLEATIAALKQKLAQAQDALDALCKHLARLQADIACKANSMLLDTKCMDTRRKLTVPAERFVPEVDTFTRTTNSTLSPLKSCQLELA

SEQ ID NO: 233 - protein, 1085 aa, Homo sapiens
MDTPENVLQMLEAHMQSYKGNDPLGEWERYIQWVEENFPENKEYLITLLEHLMKEFLDKKKYHNDPRFISYCLKFAEYNSDLHQFFEFLYNHGIGTLSSPLYIAWAGHLEAQGELQHASAVLQRGIQNQAEPREFLQQQYRLFQTRLTETHLPAQARTSEPLHNVQVLNQMITSKSNPGNNMACISKNQGSELSGVISSACDKESNMERRVITISKSEYSVHSSLASKVDVEQVVMYCKEKLIRGESEFSFEELRAQKYNQRRKHEQWVNEDRHYMKRKEANAFEEQLLKQKMDELHKKLHQVVETSHEDLPASQERSEVNPARMGPSVGSQQELRAPCLPVTYQQTPVNMEKNPREAPPVVPPLANAISAALVSPATSQSIAPPVPLKAQTVTDSMFAVASKDAGCVNKSTHEFKPQSGAEIKEGCETHKVANTSSFHTTPNTSLGMVQATPSKVQPSPTVHTKEALGFIMNMFQAPTLPDISDDKDEWQSLDQNEDAFEAQFQKNVRSSGAWGVNKIISSLSSAFHVFEDGNKENYGLPQPKNKPTGARTFGERSVSRLPSKPKEEVPHAEEFLDDSTVWGIRCNKTLAPSPKSPGDFTSAAQLASTPFHKLPVESVHILEDKENVVAKQCTQATLDSCEENMVVPSRDGKFSPIQEKSPKQALSSHMYSASLLRLSQPAAGGVLTCEAELGVEACRLTDTDAAIAEDPPDAIAGLQAEWMQMSSLGTVDAPNFIVGNPWDDKLIFKLLSGLSKPVSSYPNTFEWQCKLPAIKPKTEFQLGSKLVYVHHLLGEGAFAQVYEATQGDLNDAKNKQKFVLKVQKPANPWEFYIGTQLMERLKPSMQHMFMKFYSAHLFQNGSVLVGELYSYGTLLNAINLYKNTPEKVMPQGLVISFAMRMLYMIEQVHDCEIIHGDIKPDNFILGNGFLEQDDEDDLSAGLALIDLGQSIDMKLFPKGTIFTAKCETSGFQCVEMLSNKPWNYQIDYFGVAATVYCMLFGTYMKVKNEGGECKPEGLFRRLPHLDMWNEFFHVMLNIPDCHHLPSLDLLRQKLKKVFQQHYTNKIRALRNRLIVLLLECKRSRK

SEQ ID NO: 234 - DNA, 20 bp, Artificial Sequence
  Synthetic primer
actgtgccccacaaaacttc

SEQ ID NO: 235 - DNA, 20 bp, Artificial Sequence
  Synthetic primer
gaccctccttcctctcaacc

SEQ ID NO: 236 - DNA, 20 bp, Artificial Sequence
  Synthetic primer
ggctggctgtgacttaccat

SEQ ID NO: 237 - DNA, 20 bp, Artificial Sequence
  Synthetic primer
aatctgcgttgaagcagtga

SEQ ID NO: 238 - DNA, 23 bp, Artificial Sequence
  Synthetic primer
tggtatcgtggaaggactcatgc

SEQ ID NO: 239 - DNA, 24 bp, Artificial Sequence
  Synthetic primer
atgccagtgagcttcccgttcagc

The invention claimed is:

1. A method for detecting identifying, or predicting the presence of esophageal cancer comprising determining in vitro the expression level of at least an esophageal cancer-associated target nucleic acid consisting of the nucleotide sequence of SEQ ID NO:142 in a biological sample obtained from the esophagus of a human subject using a composition, kit or chip comprising:

(a) a polynucleotide consisting of the nucleotide sequence of SEQ ID NO: 142, a nucleotide sequence having at least 95% sequence identity with SEQ ID NO: 142, or a fragment of SEQ ID NO: 142 comprising at least 15 contiguous nucleotides of SEQ ID NO:142;

(b) a polynucleotide comprising the nucleotide sequence of SEQ ID NO: 142;

(c) a polynucleotide consisting of a nucleotide sequence that is a full-length complement of the nucleotide sequence of SEQ ID NO: 142, a nucleotide sequence having at least 95% sequence identity with the full-length complement of SEQ ID NO: 142, or a fragment thereof comprising at least 15 contiguous nucleotides of the full-length complement of SEQ ID NO: 142; or (d) a polynucleotide comprising a nucleotide sequence that is a full-length complement of the nucleotide sequence of SEQ ID NO: 142, wherein the determination of the expression level is compared to the expression level value obtained from a control sample and a decrease in the expression level of SEQ ID NO:142 in the biological sample detects, identifies or predicts the presence of esophageal cancer.

2. A method for detecting, identifying, or predicting the presence of esophageal cancer comprising determining in vitro an expression level of at least an esophageal cancer-associated target nucleic acid consisting of the nucleotide sequence of SEQ ID NO:142 in a biological sample obtained from the esophagus of a human subject using a composition, kit or chip comprising:

(a) a polynucleotide consisting of the nucleotide sequence of SEQ ID NO: 142, a nucleotide sequence having at least 95% sequence identity with SEQ ID NO: 142, or a fragment of SEQ ID NO: 142 comprising at least 15 contiguous nucleotides of SEQ ID NO:142;

(b) a polynucleotide comprising the nucleotide sequence of SEQ ID NO: 142;

(c) a polynucleotide consisting of a nucleotide sequence that is a full-length complement of the nucleotide sequence of SEQ ID NO: 142, a nucleotide sequence having at least 95% sequence identity with the full-length complement of SEQ ID NO: 142, or a fragment thereof comprising at least 15 contiguous nucleotides of the full-length complement of SEQ ID NO: 142; or (d) a polynucleotide comprising a nucleotide sequence that is a full-length complement of the nucleotide sequence of SEQ ID NO: 142, wherein the method comprises the following steps:

(1) determining in vitro expression levels of the target nucleic acid consisting of the nucleotide sequence of SEQ ID NO:142 in a plurality of biological samples from one or more humans that are known to be of an esophageal cancer cell-containing tissue or a normal tissue using said composition, kit or chip;

(2) preparing a discriminant, support vector machine, made using as training samples the expression levels of the target nucleic acids determined in step (1);

(3) determining in vitro an expression level of the target nucleic acid consisting of the nucleotide sequence of SEQ ID NO:142 in a biological sample obtained from the esophagus of a human subject with the same method of measurement as in step (1); and (4) assigning the expression level of the target nucleic acid consisting of the nucleotide sequence of SEQ ID NO:142 determined in step (3) to the discriminant prepared in step (2), and determining whether or not the biological sample of step (3) includes cancer cells, based on the results obtained from the discriminant wherein the presence of cancer cells in the biological sample detects, identifies or predicts the presence of esophageal cancer in the human subject.

3. The method of claim 1 further comprising determining in vitro the expression levels of one or more additional esophageal cancer-associated target nucleic acids selected from the group consisting of the nucleic acids consisting of SEQ ID NO: 143 to 155 and 157 to 161 in a biological sample obtained from the esophagus of the human subject, using a composition, kit or chip comprising:

(a') a polynucleotide consisting of the nucleotide sequence of any one of SEQ ID NOS: 143 to 155 and 157 to 161, a nucleotide sequence having at least 95% sequence identity with any one of SEQ ID NOS: 143 to 155 and 157 to 161, or a fragment of any one of SEQ ID NOS: 143 to 155 and 157 to 161 comprising at least 15 contiguous nucleotides of any one of SEQ ID NOS:143 to 155 and 157 to 161;

(b') a polynucleotide comprising the nucleotide sequence of any one of SEQ ID NOS: 143 to 155 and 157 to 161;

(c') a polynucleotide consisting of a nucleotide sequence that is a full-length complement of the nucleotide sequence as shown in any one of SEQ ID NOS: 143 to 155 and 157 to 161, a nucleotide sequence having at least 95% sequence identity with the full-length complement of any one of SEQ ID NOS: I43 to 155 and 157 to 161, or a fragment of any one of SEQ 1D NOS: 143 to 155 and 157 to 161 comprising at least 15 contiguous nucleotides of the full-length complement of any one of SEQ ID NOS:143 to 155 and 157 to 161; or (d') a polynucleotide comprising a nucleotide sequence that is a full-length complement of the nucleotide sequence of any one of SEQ ID NOS: 143 to 155 and 157 to 161, wherein the determination of the expression level is compared to the expression level obtained from a control sample and a decrease in the expression level of SEQ ID NO: 142 and any one of SEQ ID NOS:143 to 155 and 157 to 161 in the biological sample is indicative of the presence of esophageal cancer.

4. The method of claim 1 further comprising determining in vitro the expression levels of one or more additional esophageal cancer-associated target nucleic acids selected from the group consisting of the nucleic acids consisting of SEQ ID NO: 143 to 155, 156 and 157 to 161 in a biological sample obtained from the esophagus of the human subject, using a composition, kit or chip comprising:

(a') a polynucleotide consisting of the nucleotide sequence of any one of SEQ ID NOS: 143 to 155, 156 and 157 to 161, a nucleotide sequence having at least 95% sequence identity with any one of SEQ ID NOS: 143 to 155, 156 and 157 to 161, or a fragment of any one of SEQ ID NOS: 143 to 155, 156 and 157 to 161 comprising at least 15 contiguous nucleotides of any one of SEQ ID NOS: 143 to 155, 156 and 157 to 161;

(b') a polynucleotide comprising the nucleotide sequence of any one of SEQ ID NOS: 143 to 155, 156 and 157 to 161;

(c') a polynucleotide consisting of a nucleotide sequence that is a full-length complement of the nucleotide sequence as shown in any one of SEQ ID NOS: 143 to 155, 156 and 157 to 161, a nucleotide sequence having at least 95% sequence identity with the full-length complement of any one of SEQ ID NOS: I43 to 155, 156 and 157 to 161, or a fragment of any one of SEQ 1D NOS: 143 to 155, 156 and 157 to 161 comprising at least 15 contiguous nucleotides of the full-length complement of any one of SEQ ID NOS:143 to 155, 156 and 157 to 161; or (d') a polynucleotide comprising a nucleotide sequence that is a full-length complement of the nucleotide sequence of any one of SEQ ID NOS: 143 to 155, 156 and 157 to 161, wherein the determination of the expression level is compared to the expression level obtained from a control sample and a decrease in the expression level of SEQ ID NO: 142 and any one of SEQ ID NOS:143 to 155, 156 and 157 to 161 in the biological sample is indicative of the presence of esophageal cancer.

5. The method of claim 2, further comprising determining in vitro the expression level of one or more additional esophageal cancer-associated target nucleic acids in a biological sample obtained from the esophagus of the human subject, wherein the one or more additional esophageal cancer-associated target nucleic acids is selected from the group consisting of SEQ ID NO: 143 to 155 and 157 to 161.

6. The method of claim 2, further comprising determining in vitro the expression level of one or more additional esophageal cancer-associated target nucleic acids in a biological sample obtained from the esophagus of the human subject, wherein the one or more additional esophageal cancer-associated target nucleic acids is selected from the group consisting of SEQ ID NO: 143 to 155, 156 and 157 to 161.

7. The method of claim 1 or 2 wherein said determination of the expression level of at least an esophageal cancer-associated target nucleic acid is performed with one or more techniques selected from the group consisting of Northern blotting, Southern blotting, RT-PCR, and in situ hybridization.

8. The method of claim 1 or 2, wherein determining the expression level of at least an esophageal cancer-associated target nucleic acid is performed using a DNA chip or microarray.

* * * * *

UNITED STATES PATENT AND TRADEMARK OFFICE
Certificate

Patent No. 7,932,032 B2

Patented: April 26, 2011

On petition requesting issuance of a certificate for correction of inventorship pursuant to 35 U.S.C. 256, it has been found that the above identified patent, through error and without any deceptive intent, improperly sets forth the inventorship.

Accordingly, it is hereby certified that the correct inventorship of this patent is: Hideo Akiyama, Kanagawa (JP); Satoko Kozono, Kanagawa (JP); Akira Myomoto, Shiga (JP); Osamu Nomura, Kanagawa (JP); Hitoshi Nobumasa, Shiga (JP); Yutaka Shimada, Kyoto (JP); and Gozoh Tsujimoto, Kyoto (JP).

Signed and Sealed this Twentieth Day of May 2014.

DAVE NGUYEN
*Supervisory Patent Examiner*
Art Unit 1634
Technology Center 1600